United States Patent
Liu et al.

(10) Patent No.: US 10,167,457 B2
(45) Date of Patent: Jan. 1, 2019

(54) NUCLEOBASE EDITORS AND USES THEREOF

(71) Applicant: President and Fellows of Harvard College, Cambridge, MA (US)

(72) Inventors: David R. Liu, Lexington, MA (US); Alexis Christine Komor, Pasadena, CA (US); Holly A. Rees, Cambridge, MA (US); Yongjoo Kim, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

(21) Appl. No.: 15/331,852

(22) Filed: Oct. 22, 2016

(65) Prior Publication Data

US 2017/0121693 A1   May 4, 2017

Related U.S. Application Data

(60) Provisional application No. 62/408,686, filed on Oct. 14, 2016, provisional application No. 62/398,490, filed on Sep. 22, 2016, provisional application No. 62/370,700, filed on Aug. 3, 2016, provisional application No. 62/357,352, filed on Jun. 30, 2016, provisional application No. 62/357,332, filed on Jun. 30, 2016, provisional application No. 62/322,178, filed on Apr. 13, 2016, provisional application No. 62/311,763, filed on Mar. 22, 2016, provisional application No. 62/279,346, filed on Jan. 15, 2016, provisional application No. 62/245,828, filed on Oct. 23, 2015.

(51) Int. Cl.
 *C12N 15/85* (2006.01)
 *C12N 9/22* (2006.01)
 *C12N 15/63* (2006.01)
 *C12N 15/01* (2006.01)
 *C12N 9/96* (2006.01)
 *C12N 15/90* (2006.01)
 *C12N 9/78* (2006.01)
 *C12N 9/24* (2006.01)
 *C07K 14/32* (2006.01)

(52) U.S. Cl.
 CPC ............... *C12N 9/22* (2013.01); *C07K 14/32* (2013.01); *C12N 9/2497* (2013.01); *C12N 9/78* (2013.01); *C12N 15/907* (2013.01); *C12Y 305/04005* (2013.01); *C07K 2319/00* (2013.01); *C07K 2319/09* (2013.01); *C07K 2319/80* (2013.01)

(58) Field of Classification Search
 None
 See application file for complete search history.

(56) References Cited

U.S. PATENT DOCUMENTS

| | | |
|---|---|---|
| 4,235,871 A | 11/1980 | Papahadjopoulos et al. |
| 4,501,728 A | 2/1985 | Geho et al. |
| 4,737,323 A | 4/1988 | Martin et al. |
| 4,837,028 A | 6/1989 | Allen |
| 5,580,737 A | 12/1996 | Polisky et al. |
| 5,767,099 A | 6/1998 | Harris et al. |
| 5,780,053 A | 7/1998 | Ashley et al. |
| 5,830,430 A | 11/1998 | Unger et al. |
| 5,851,548 A | 12/1998 | Dattagupta et al. |
| 5,855,910 A | 1/1999 | Ashley et al. |
| 6,057,153 A | 5/2000 | George et al. |
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,607,882 B1 | 8/2003 | Cox, III et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,163,824 B2 | 1/2007 | Cox, III et al. |
| 7,479,573 B2 | 1/2009 | Chu et al. |
| 7,794,931 B2 | 9/2010 | Breaker et al. |
| 7,919,277 B2 | 4/2011 | Russell et al. |
| 7,993,672 B2 | 8/2011 | Huang et al. |
| 8,361,725 B2 | 1/2013 | Russell et al. |

(Continued)

FOREIGN PATENT DOCUMENTS

| | | |
|---|---|---|
| AU | 2012244264 A1 | 11/2012 |
| AU | 2015252023 A1 | 11/2015 |

(Continued)

OTHER PUBLICATIONS

Addgene (Plasmid #73021, pCMV-BE3, 2017).*

(Continued)

*Primary Examiner* — Julie Wu

(74) *Attorney, Agent, or Firm* — Wolf, Greenfield & Sacks, P.C.

(57) ABSTRACT

Some aspects of this disclosure provide strategies, systems, reagents, methods, and kits that are useful for the targeted editing of nucleic acids, including editing a single site within the genome of a cell or subject, e.g., within the human genome. In some embodiments, fusion proteins of Cas9 and nucleic acid editing proteins or protein domains, e.g., deaminase domains, are provided. In some embodiments, methods for targeted nucleic acid editing are provided. In some embodiments, reagents and kits for the generation of targeted nucleic acid editing proteins, e.g., fusion proteins of Cas9 and nucleic acid editing proteins or domains, are provided.

23 Claims, 138 Drawing Sheets

Specification includes a Sequence Listing.

(56) References Cited

U.S. PATENT DOCUMENTS

| | | |
|---|---|---|
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,680,069 B2 | 3/2014 | de Fougerolles et al. |
| 8,691,750 B2 | 4/2014 | Constien et al. |
| 8,697,359 B1 | 4/2014 | Zhang |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,846,578 B2 | 9/2014 | McCray et al. |
| 8,993,233 B2 | 3/2015 | Zhang et al. |
| 8,999,641 B2 | 4/2015 | Zhang et al. |
| 9,068,179 B1 | 6/2015 | Liu et al. |
| 9,163,284 B2 | 10/2015 | Liu et al. |
| 9,228,207 B2 | 1/2016 | Liu et al. |
| 9,234,213 B2 | 1/2016 | Wu |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,512,446 B1 | 12/2016 | Joung et al. |
| 9,526,724 B2 | 12/2016 | Liu et al. |
| 9,737,604 B2 | 8/2017 | Liu et al. |
| 2004/0003420 A1 | 1/2004 | Kuhn et al. |
| 2004/0115184 A1 | 6/2004 | Smith et al. |
| 2005/0222030 A1 | 10/2005 | Allison et al. |
| 2006/0088864 A1 | 4/2006 | Smolke et al. |
| 2007/0264692 A1 | 11/2007 | Liu et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0316643 A1 | 12/2010 | Eckert et al. |
| 2011/0059160 A1 | 3/2011 | Essner et al. |
| 2011/0104787 A1* | 5/2011 | Church .................. C12N 9/78 435/227 |
| 2011/0189776 A1 | 8/2011 | Terns et al. |
| 2011/0217739 A1 | 9/2011 | Terns et al. |
| 2012/0129759 A1 | 5/2012 | Liu et al. |
| 2012/0141523 A1 | 6/2012 | Castado et al. |
| 2012/0270273 A1 | 10/2012 | Zhang et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0344117 A1 | 12/2013 | Mirosevich et al. |
| 2014/0004280 A1 | 1/2014 | Loomis et al. |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0186843 A1 | 7/2014 | Zhang et al. |
| 2014/0186958 A1 | 7/2014 | Zhang et al. |
| 2014/0234289 A1 | 8/2014 | Liu et al. |
| 2014/0248702 A1 | 9/2014 | Cong |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens et al. |
| 2015/0218573 A1 | 8/2015 | Logue et al. |
| 2015/0225773 A1 | 8/2015 | Farmer et al. |
| 2015/0252358 A1 | 9/2015 | Maeder et al. |
| 2015/0315252 A1 | 11/2015 | Haugwitz et al. |
| 2016/0017393 A1 | 1/2016 | Jacobson et al. |
| 2016/0017396 A1 | 1/2016 | Cann et al. |
| 2016/0032353 A1 | 2/2016 | Braman et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0138046 A1 | 5/2016 | Wu et al. |
| 2016/0015682 A2 | 6/2016 | Liu et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |

(56) References Cited

U.S. PATENT DOCUMENTS

| | | | |
|---|---|---|---|
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0087224 A1 | 3/2017 | Quake et al. |
| 2017/0087225 A1 | 3/2017 | Quake et al. |
| 2017/0088587 A1 | 3/2017 | Quake et al. |
| 2017/0088828 A1 | 3/2017 | Quake et al. |
| 2017/0107560 A1 | 4/2017 | Peter et al. |
| 2017/0114367 A1 | 4/2017 | Chen et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0191047 A1 | 7/2017 | Terns et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0283797 A1 | 10/2017 | Robb et al. |

FOREIGN PATENT DOCUMENTS

| | | |
|---|---|---|
| AU | 2015101792 | 1/2016 |
| CA | 2 852 593 A1 | 11/2015 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |

(56) References Cited

FOREIGN PATENT DOCUMENTS

| | | |
|---|---|---|
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 3/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |

(56) References Cited

FOREIGN PATENT DOCUMENTS

| | | |
|---|---|---|
| CN | 107177591 A | 9/2017 |
| CN | 107177595 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| EP | 2 604 255 A1 | 6/2013 |
| EP | 2 966 170 A1 | 1/2016 |
| EP | 3 009 511 A2 | 4/2016 |
| EP | 3199632 A1 | 8/2017 |
| GB | 2 528 177 A | 1/2016 |
| GB | 2 531 454 A1 | 4/2016 |
| GB | 2542653 A | 3/2017 |
| JP | 2007-501626 A | 2/2007 |
| JP | 2010-539929 A | 12/2010 |
| KR | 101584933 B1 | 1/2016 |
| KR | 20160133380 A | 11/2016 |
| KR | 20170037028 A | 4/2017 |
| KR | 101748575 B1 | 6/2017 |
| RU | 2016104674 A | 8/2017 |
| WO | WO 2001/38547 A2 | 5/2001 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2006/002547 A1 | 1/2006 |
| WO | WO 2006/042112 A1 | 4/2006 |
| WO | WO 2007/025097 A2 | 3/2007 |
| WO | WO 2007/136815 A2 | 11/2007 |
| WO | WO 2007/143574 A1 | 12/2007 |
| WO | WO 2008/108989 A2 | 9/2008 |
| WO | WO 2009/134808 A2 | 11/2009 |
| WO | WO 2010/011961 A2 | 1/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A2 | 5/2011 |
| WO | WO 2011/053982 A2 | 5/2011 |
| WO | WO 2011/075627 A1 | 6/2011 |
| WO | WO 2011/091311 A2 | 7/2011 |
| WO | WO 2011/109031 A1 | 9/2011 |
| WO | WO 2011/143124 A2 | 11/2011 |
| WO | WO 2012/054726 A1 | 4/2012 |
| WO | WO 2012/065043 A2 | 5/2012 |
| WO | WO 2012/125445 A2 | 9/2012 |
| WO | WO 2012/138927 A2 | 10/2012 |
| WO | WO 2012/158985 A2 | 11/2012 |
| WO | WO 2012/158986 A2 | 11/2012 |
| WO | WO 2012/164565 A1 | 12/2012 |
| WO | WO 2013/012674 A1 | 1/2013 |
| WO | WO 2013/013105 A2 | 1/2013 |
| WO | WO 2013/066438 A2 | 5/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142378 A9 | 9/2013 |
| WO | WO 2013/142578 A2 | 9/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014089290 A1 * | 6/2014 ............... C12N 9/22 |
| WO | WO 2014/104878 A1 | 7/2014 |
| WO | WO 2014/110006 A1 | 7/2014 |

(56) References Cited

FOREIGN PATENT DOCUMENTS

| | | |
|---|---|---|
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/153118 A1 | 9/2014 |
| WO | WO 2014/153470 A2 | 9/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A1 | 10/2014 |
| WO | WO 2014/172489 A2 | 10/2014 |
| WO | WO-2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014186686 A2 * | 11/2014 ......... C12N 15/8213 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A2 | 6/2015 |
| WO | WO 2015/086798 A1 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |

(56) References Cited

FOREIGN PATENT DOCUMENTS

| | | |
|---|---|---|
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A1 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |

(56) References Cited

FOREIGN PATENT DOCUMENTS

| | | |
|---|---|---|
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2015/048801 A2 | 4/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A2 | 4/2016 |
| WO | WO 2016/057951 A2 | 4/2016 |
| WO | WO 2016/057961 A2 | 4/2016 |
| WO | WO 2016/061073 A1 | 4/2016 |
| WO | WO 2016/061374 A1 | 4/2016 |
| WO | WO-2016/061481 A1 | 4/2016 |
| WO | WO 2016/061523 A1 | 4/2016 |
| WO | WO-2016/069282 A1 | 5/2016 |
| WO | WO-2016/069283 A1 | 5/2016 |
| WO | WO 2016/069591 A2 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO-2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/112351 A1 | 7/2016 |
| WO | WO 2016/112963 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/130600 A2 | 8/2016 |
| WO | WO 2016/130697 A1 | 8/2016 |
| WO | WO 2016/132122 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO-2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO-2016/167300 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |

(56) References Cited

FOREIGN PATENT DOCUMENTS

| | | |
|---|---|---|
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A2 | 12/2016 |
| WO | WO 2016/205764 A2 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO-2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO-2017/043573 A1 | 3/2017 |
| WO | WO-2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/058658 A2 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO-2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/068377 A1 | 4/2017 |
| WO | WO 2017/069829 A1 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO-2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO-2017/106528 A2 | 6/2017 |
| WO | WO-2017/106537 A2 | 6/2017 |

(56) References Cited

FOREIGN PATENT DOCUMENTS

| | | |
|---|---|---|
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO-2017/112620 A1 | 6/2017 |
| WO | WO-2017/115268 A1 | 7/2017 |
| WO | WO-2017/117395 A1 | 7/2017 |
| WO | WO-2017/118720 A1 | 7/2017 |
| WO | WO-2017/123609 A1 | 7/2017 |
| WO | WO-2017/123910 A1 | 7/2017 |
| WO | WO-2017/124086 A1 | 7/2017 |
| WO | WO-2017/124100 A1 | 7/2017 |
| WO | WO-2017/124652 A1 | 7/2017 |
| WO | WO-2017/126987 A1 | 7/2017 |
| WO | WO-2017/127807 A1 | 7/2017 |
| WO | WO-2017/131237 A1 | 8/2017 |
| WO | WO-2017/132112 A1 | 8/2017 |
| WO | WO-2017/136520 A1 | 8/2017 |
| WO | WO-2017/136629 A1 | 8/2017 |
| WO | WO-2017/136794 A1 | 8/2017 |
| WO | WO-2017/139264 A1 | 8/2017 |
| WO | WO-2017/139505 A2 | 8/2017 |
| WO | WO-2017/142835 A1 | 8/2017 |
| WO | WO-2017/142999 A2 | 8/2017 |
| WO | WO-2017/143042 A2 | 8/2017 |
| WO | WO-2017/147278 A1 | 8/2017 |
| WO | WO-2017/147432 A1 | 8/2017 |
| WO | WO-2017/147446 A1 | 8/2017 |
| WO | WO-2017/147555 A1 | 8/2017 |
| WO | WO-2017/151444 A1 | 9/2017 |
| WO | WO-2017/152015 A1 | 9/2017 |
| WO | WO-2017/157422 A1 | 9/2017 |
| WO | WO-2017/158153 A1 | 9/2017 |
| WO | WO-2017/160689 A1 | 9/2017 |
| WO | WO-2017/160752 A1 | 9/2017 |
| WO | WO-2017/160890 A1 | 9/2017 |
| WO | WO-2017/161068 A1 | 9/2017 |
| WO | WO-2017/165826 A1 | 9/2017 |
| WO | WO-2017/165862 A1 | 9/2017 |
| WO | WO-2017/172644 A2 | 10/2017 |
| WO | WO-2017/172645 A2 | 10/2017 |
| WO | WO-2017/172860 A1 | 10/2017 |
| WO | WO-2017/173004 A1 | 10/2017 |
| WO | WO-2017/173092 A1 | 10/2017 |
| WO | WO-2017/174329 A1 | 10/2017 |
| WO | WO-2017/176529 A1 | 10/2017 |
| WO | WO-2017/178590 A1 | 10/2017 |
| WO | WO-2017/180694 A1 | 10/2017 |
| WO | WO-2017/180711 A1 | 10/2017 |
| WO | WO-2017/180915 A2 | 10/2017 |
| WO | WO-2017/180926 A1 | 10/2017 |
| WO | WO-2017/181107 A2 | 10/2017 |
| WO | WO-2017/181735 A2 | 10/2017 |
| WO | WO-2017/182468 A1 | 10/2017 |
| WO | WO-2017/184334 A1 | 10/2017 |
| WO | WO-2017/184768 A1 | 10/2017 |
| WO | WO-2017/184786 A1 | 10/2017 |

OTHER PUBLICATIONS

Addgene (Plasmid #79620, 2017).*
Addgene (Plasmid #44246, 2017).*
Ma et al. (Nature Method, 2016, 13:102-1035, published online on Oct. 10, 2016).*
Kitamura et al. (PLOS, 2013, 9:e1003361, labeled p. 1-14).*
Kitamura et al. (PLOS Pathogen, 2013, 9:e1003361, labeled p. 1-14).*
Guilinger et al. (Nature Biotechnology, 2014, 32:577-583 and supplemental pp. 1-42; published on Apr. 25, 2014).*
U.S. Appl. No. 14/234,031, filed Mar. 24, 2014, Liu et al.
U.S. Appl. No. 14/320,271, filed Jun. 30, 2014, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 14/103,608, filed Jun. 10, 2016, Liu et al.
U.S. Appl. No. 14/529,010, filed Oct. 30, 2014, Liu et al.
PCT/US2013/032589, dated Jul. 26, 2013, International Search Report.
PCT/US2012/047778, dated May 30, 2013, International Search Report and Written Opinion.
PCT/US2012/047778, dated Feb. 6, 2014, International Preliminary Report on Patentability.
EP 123845790.0, dated Mar. 18, 2015, Partial Supplementary European Search Report.
EP 123845790.0, dated Oct. 12, 2015, Supplementary European Search Report.
PCT/US2014/052231, dated Dec. 4, 2014, International Search Report and Written Opinion.
PCT/US2014/052231, dated Jan. 30, 2015, International Search Report and Written Opinion (Corrected Version).
PCT/US2014/052231, dated Mar. 3, 2016, International Preliminary Report on Patentability.
PCT/US2014/050283, dated Nov. 6, 2014, International Search Report and Written Opinion.
PCT/US2014/050283, dated Feb. 18, 2016, International Preliminary Report on Patentability.
PCT/US2014/054247, dated Mar. 27, 2015, International Search Report and Written Opinion.
PCT/US2014/054247, dated Mar. 17, 2016, International Preliminary Report on Patentability.
PCT/US2014/054291, dated Dec. 18, 2014, Invitation to Pay Additional Fees.
PCT/US2014/054291, dated Mar. 27, 2015, International Search Report and Written Opinion.
PCT/US2014/054291, dated Mar. 17, 2016, International Preliminary Report on Patentability.
PCT/US2014/054252, dated Mar. 5, 2015, International Search Report and Written Opinion.
PCT/US2014/054252, dated Mar. 17, 2016, International Preliminary Report on Patentability.
PCT/US2014/070038, dated Apr. 14, 2015, International Search Report and Written Opinion.
PCT/US2014/070038, dated Jun. 23, 2016, International Preliminary Report on Patentability.
PCT/US2015/042770, dated Feb. 23, 2016, International Search Report and Written Opinion.
PCT/US2015/042770, dated Dec. 19, 2016, International Preliminary Report on Patentability.
PCT/US2015/058479, dated Feb. 11, 2016, International Search Report and Written Opinion.
International Preliminary Report on Patentability for PCT/US2015/058479, dated May 11, 2017.
Invitation to Pay Additional Fees for PCT/US2016/058344, dated Mar. 1, 2017.
International Search Report and Written Opinion for PCT/US2016/058344, dated Apr. 20, 2017.

(56) References Cited

OTHER PUBLICATIONS

Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Barnes et al., Repair and genetic consequences of endogenous DNA base damage in mammalian cells. Annu Rev Genet. 2004;38:445-76.
Beale et al., Comparison of the differential context-dependence of DNA deamination by APOBEC enzymes: correlation with mutation spectra in vivo. J Mol Biol. Mar. 26, 2004;337(3):585-96.
Begley, Scientists unveil the 'most clever CRISPR gadget' so far. STAT, Apr. 20, 2016. https://www.statnews.com/2016/04/20/clever-crispr-advance-unveiled/.
Birling et al., Site-specific recombinases for manipulation of the mouse genome. Methods Mol Biol. 2009;561:245-63. doi: 10.1007/978-1-60327-019-9_16.
Borman, Improved route to single-base genome editing. Chemical & Engineering News, Apr. 25, 2016;94(17)p5. http://cen.acs.org/articles/94/i17/Improved-route-single-base-genome.html.
Britt et al., Re-engineering plant gene targeting. Trends Plant Sci. Feb. 2003;8(2):90-5.
Brusse et al., Spinocerebellar ataxia associated with a mutation in the fibroblast growth factor 14 gene (SCA27): A new phenotype. Mov Disord. Mar. 2006;21(3):396-401.
Buchholz et al., Alteration of Cre recombinase site specificity by substrate-linked protein evolution. Nat Biotechnol. Nov. 2001;19(11):1047-52.
Caldecott et al., Single-strand break repair and genetic disease. Nat Rev Genet. Aug. 2008;9(8):619-31. doi: 10.1038/nrg2380.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. doi: https://doi.org/10.1101/058974. [Preprint].
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chu et al., Increasing the efficiency of homology-directed repair for CRISPR-Cas9-induced precise gene editing in mammalian cells. Nat Biotech. Feb. 13, 2015;33:543-8.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Therapeutic genome editing: prospects and challenges. Nat Med. Feb. 2015;21(2):121-31. doi: 10.1038/nm.3793.
Cunningham et al., Ensembl 2015. Nucleic Acids Res. Jan. 2015;43(Database issue):D662-9. doi: 10.1093/nar/gku1010. Epub Oct. 28, 2014.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
Dormiani et al., Long-term and efficient expression of human (β-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hilton et al., Enabling functional genomics with genome engineering. Genome Res. Oct. 2015;25(10):1442-55. doi: 10.1101/gr.190124.115.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Kellendonk et al., Regulation of Cre recombinase activity by the synthetic steroid RU 486. Nucleic Acids Res. Apr. 15, 1996;24(8):1404-11.
Kim et al., The role of apolipoprotein E in Alzheimer's disease. Neuron. Aug. 13, 2009;63(3):287-303. doi: 10.1016/j.neuron.2009.06.026.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Ledford, Gene-editing hack yields pinpoint precision. Nature, Apr. 20, 2016. http://www.nature.com/news/gene-editing-hack-yields-pinpoint-precision-1.19773.

(56) References Cited

OTHER PUBLICATIONS

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., Recognition of liposomes by cells: in vitro binding and endocytosis mediated by specific lipid headgroups and surface charge density. Biochim Biophys Acta. Jan. 31, 1992;1103(2):185-97.

Lin et al., Enhanced homology-directed human genome engineering by controlled timing of CRISPR/Cas9 delivery. Elife. Dec. 15, 2014;3:e04766. doi: 10.7554/eLife.04766.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Lundquist et al., Site-directed mutagenesis and characterization of uracil-DNA glycosylase inhibitor protein. Role of specific carboxylic amino acids in complex formation with *Escherichia coli* uracil—DNA glycosylase. J Biol Chem. Aug. 22, 1997;272(34):21408-19.

Marioni et al., DNA methylation age of blood predicts all-cause mortality in later life. Genome Biol. Jan. 30, 2015;16:25. doi: 10.1186/s13059-015-0584-6.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Mol et al., Crystal structure of human uracil-DNA glycosylase in complex with a protein inhibitor: protein mimicry of DNA. Cell. Sep. 8, 1995;82(5):701-8.

Offord, Advances in Genome Editing. The Scientist, Apr. 20, 2016. http://www.the-scientist.com/?articles.view/articleNo/45903/title/Advances-in-Genome-Editing/.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Petolino et al., Editing Plant Genomes: a new era of crop improvement. Plant Biotechnol J. Feb. 2016;14(2):435-6. doi: 10.1111/pbi.12542.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.

Prorocic et al., Zinc-finger recombinase activities in vitro. Nucleic Acids Res. Nov. 2011;39(21):9316-28. doi: 10.1093/nar/gkr652. Epub Aug. 17, 2011.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Rath et al., Fidelity of end joining in mammalian episomes and the impact of Metnase on joint processing. BMC Mol Biol. Mar. 22, 2014;15:6. doi: 10.1186/1471-2199-15-6.

Rebuzzini et al., New mammalian cellular systems to study mutations introduced at the break site by non-homologous end-joining. DNA Repair (Amst). May 2, 2005;4(5):546-55.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Sadelain et al., Safe harbours for the integration of new DNA in the human genome. Nat Rev Cancer. Dec. 1, 2011;12(1):51-8. doi: 10.1038/nrc3179.

Sanjana et al., A transcription activator-like effector toolbox for genome engineering. Nat Protoc. Jan. 5, 2012;7(1):171-92. doi: 10.1038/nprot.2011.431.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

Seripa et al., The missing ApoE allele. Ann Hum Genet. Jul. 2007;71(Pt 4):496-500. Epub Jan. 22, 2007.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.

Simonelli et al., Base excision repair intermediates are mutagenic in mammalian cells. Nucleic Acids Res. Aug. 2, 2005;33(14):4404-11. Print 2005.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sjoblom et al., The consensus coding sequences of human breast and colorectal cancers. Science. Oct. 13, 2006;314(5797):268-74. Epub Sep. 7, 2006.

Slaymaker et al., Rationally engineered Cas9 nucleases with improved specificity. Science. Jan. 1, 2016;351(6268):84-8. doi: 10.1126/science.aad5227. Epub Dec. 1, 2015.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.

Swarts et al., DNA-guided DNA interference by a prokaryotic Argonaute. Nature. Mar. 13, 2014;507(7491):258-61. doi: 10.1038/nature12971. Epub Feb. 16, 2014.

(56) References Cited

OTHER PUBLICATIONS

Swarts et al., The evolutionary journey of Argonaute proteins. Nat Struct Mol Biol. Sep. 2014;21(9):743-53. doi: 10.1038/nsmb.2879.
Tagalakis et al., Lack of RNA-DNA oligonucleotide (chimeraplast) mutagenic activity in mouse embryos. Mol Reprod Dev. Jun. 2005;71(2):140-4.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Wang et al., Nucleation, propagation and cleavage of target RNAs in Ago silencing complexes. Nature. Oct. 8, 2009;461(7265):754-61. doi: 10.1038/nature08434.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric CRE recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yuen et al., Control of transcription factor activity and osteoblast differentiation in mammalian cells using an evolved small-molecule-dependent intein. J Am Chem Soc. Jul. 12, 2006;128(27):8939-46.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zuris et al., Cationic lipid-mediated delivery of proteins enables efficient protein-based genome editing in vitro and in vivo. Nat Biotechnol. 2015;33:73-80.
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
International Search Report for PCT/US2013/032589, dated Jul. 26, 2013.
Partial Supplementary European Search Report for Application No. EP 12845790.0, dated Mar. 18, 2015.
Supplementary European Search Report for Application No. EP 12845790.0, dated Oct. 12, 2015.
International Search Report and Written Opinion for PCT/US2012/047778, dated May 30, 2013.
International Preliminary Report on Patentability for PCT/US2012/047778, dated Feb. 6, 2014.
International Search Report and Written Opinion for PCT/US2014/052231, dated Dec. 4, 2014.
International Search Report and Written Opinion for PCT/US2014/052231, dated Jan. 30, 2015.
International Preliminary Report on Patentability for PCT/US2014/052231, dated Mar. 3, 2016.
International Search Report and Written Opinion for PCT/US2014/050283, dated Nov. 6, 2014.
International Preliminary Report on patentability for PCT/US2014/050283, dated Feb. 18, 2016.
International Search Report and Written Opinion for PCT/US2014/054247, dated Mar. 27, 2015.
International Preliminary Report on Patentability for PCT/US2014/054247, dated Mar. 17, 2016.
Invitation to Pay Additional Fees for PCT/US2014/054291, dated Dec. 18, 2014.
International Search Report and Written Opinion for PCT/US2014/054291, dated Mar. 27, 2015.
International Preliminary Report on Patentability for PCT/US2014/054291, dated Mar. 17, 2016.
International Search Report and Written Opinion for PCT/US2014/054252, dated Mar. 5, 2015.
International Preliminary Report on Patentability or PCT/US2014/054252, dated Mar. 17, 2016.
International Search Report and Written Opinion for PCT/US2014/070038, dated Apr. 14, 2015.
International Preliminary Report on Patentability for PCT/US2014/070038, dated Jun. 23, 2016.
International Search Report and Written Opinion for PCT/US2015/042770, dated Feb. 23, 2016.
International Preliminary Report on Patentability for PCT/US2015/042770, dated Dec. 19, 2016.
International Search Report and Written Opinion for PCT/US2015/058479, dated Feb. 11, 2016.
[No Author Listed], EMBL. Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Adrian et al., Targeted SAINT-O-Somes for improved intracellular delivery of siRNA and cytotoxic drugs into endothelial cells. J Control Release. Jun. 15, 2010;144(3):341-9. doi: 10.1016/j.jconrel.2010.03.003. Epub Mar. 11, 2010.
Aguilera et al., Systemic in vivo distribution of activatable cell penetrating peptides is superior to that of cell penetrating peptides. IntegR Biol (Camb). Jun. 2009;1(5-6):371-81. doi: 10.1039/b904878b. Epub May 11, 2009.
Aihara et al., A conformational switch controls the DNA cleavage activity of lambda integrase. Mol Cell. Jul. 2003;12(1):187-98.
Akinc et al., A combinatorial library of lipid-like materials for delivery of RNAi therapeutics. Nat Biotechnol. May 2008;26(5):561-9. doi: 10.1038/nbt1402. Epub Apr. 27, 2008.
Akopian et al., Chimeric recombinases with designed DNA sequence recognition. Proc Natl Acad Sci USA. Jul. 22, 2003;100(15):8688-91. Epub Jul. 1, 2003.

(56) References Cited

OTHER PUBLICATIONS

Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Allen et al., Liposomal drug delivery systems: from concept to clinical applications. Adv Drug Deliv Rev. Jan. 2013;65(1):36-48. doi: 10.1016/j.addr.2012.09.037. Epub Oct. 1, 2012.
Al-Taei et al., Intracellular traffic and fate of protein transduction domains HIV-1 TAT peptide and octaarginine. Implications for their utilization as drug delivery vectors. Bioconjug Chem. Jan.-Feb. 2006;17(1):90-100.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Arnold et al., Mutants of Tn3 resolvase which do not require accessory binding sites for recombination activity. EMBO J. Mar. 1, 1999;18(5):1407-14.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Basha et al., Influence of cationic lipid composition on gene silencing properties of lipid nanoparticle formulations of siRNA in antigen-presenting cells. Mal Ther. Dec. 2011;19(12):2186-200. doi: 10.1038/mt.2011.190. Epub Oct. 4, 2011.
Batey et al., Structure of a natural guanine-responsive riboswitch complexed with the metabolite hypoxanthine. Nature. Nov. 18, 2004;432(7015):411-5.
Bedell et al., In vivo genome editing using a high-efficiency TALEN system. Nature. Nov. 1, 2012;491(7422):114-8. Doi: 10.1038/nature11537. Epub Sep. 23, 2012.
Beumer et al., Efficient gene targeting in *Drosophila* with zinc-finger nucleases. Genetics. Apr. 2006;172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bibikova et al., Stimulation of homologous recombination through targeted cleavage by chimeric nucleases. Mol Cell Biol. Jan. 2001;21(1):289-97.
Bibikova et al., Targeted chromosomal cleavage and mutagenesis in *Drosophila* using zinc-finger nucleases. Genetics. Jul. 2002;161(3):1169-75.
Boch et al., Breaking the code of DNA binding specificity of TAL-type III effectors. Science. Dec. 11, 2009;326(5959):1509-12. Doi: 10.1126/science.1178811.
Boch, TALEs of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Branden and Tooze, Introduction to Protein Structure. 1999; 2nd edition. Garland Science Publisher: 3-12.
Brown et al., Serine recombinases as tools for genome engineering. Methods. Apr. 2011;53(4):372-9. doi: 10.1016/j.ymeth.2010.12.031. Epub Dec. 30, 2010.
Bulow et al., Multienzyme systems obtained by gene fusion. Trends Biotechnol. Jul. 1991;9(7):226-31.
Bulyk et al., Exploring the DNA-binding specificities of zinc fingers with DNA microarrays. Proc Natl Acad Sci U S A. Jun. 19, 2001;98(13):7158-63. Epub Jun. 12, 2001.
Burke et al., Activating mutations of Tn3 resolvase marking interfaces important in recombination catalysis and its regulation. Mol Microbiol. Feb. 2004;51(4):937-48.
Buskirk et al., Directed evolution of ligand dependence: small-molecule-activated protein splicing. Proc Natl Acad Sci USA. Jul. 20, 2004;101(29):10505-10. Epub Jul. 9, 2004.

Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cameron, Recent advances in transgenic technology. Mol Biotechnol. Jun. 1997;7(3):253-65.
Cargill et al.,Characterization of single-nucleotide polymorphisms in coding regions of human genes. Nat Genet. Jul. 1999;22(3):231-8.
Caron et al., Intracellular delivery of a Tat-eGFP fusion protein into muscle cells. Mol Ther. Mar. 2001;3(3):310-8.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Cermak et al., Efficient design and asset al.y of custom TALEN and other TAL effector-based constructs for DNA targeting. Nucleic Acids Res. Jul. 2011;39(12):e82. Doi: 10.1093/nar/gkr218. Epub Apr. 14, 2011.
Chang et al., Modification of DNA ends can decrease end joining relative to homologous recombination in mammalian cells. Proc Natl Acad Sci U S A. Jul. 1987;84(14):4959-63.
Charpentier et al., Biotechnology: Rewriting a genome. Nature. Mar. 7, 2013;495(7439):50-1. doi: 10.1038/495050a.
Chavez et al., Therapeutic applications of the ΦC31 integrase system. Curr Gene Ther. Oct. 2011;11(5):375-81. Review.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chen et al., Fusion protein linkers: property, design and functionality. Adv Drug Deliv Rev. Oct. 2013;65(10):1357-69. doi:10.1016/j.addr.2012.09.039. Epub Sep. 29, 2012.
Chesnoy et al., Structure and function of lipid-DNA complexes for gene delivery. Annu Rev Biophys Biomol Struct. 2000;29:27-47.
Chichili et al., Linkers in the structural biology of protein-protein interactions. Protein Science. 2013;22:153-67.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cobb et al., Directed evolution: an evolving and enabling synthetic biology tool. Curr Opin Chem Biol. Aug. 2012;16(3-4):285-91. doi:10.1016/j.cbpa.2012.05.186. Epub Jun. 4, 2012. Review.

(56) References Cited

OTHER PUBLICATIONS

Cole-Strauss et al., Correction of the mutation responsible for sickle cell anemia by an RNA-DNA oligonucleotide. Science. Sep. 6, 1996;273(5280):1386-9.
Colletier et al., Protein encapsulation in liposomes: efficiency depends on interactions between protein and phospholipid bilayer. BMC Biotechnol. May 10, 2002;2:9.
Cong et al., Comprehensive interrogation of natural TALE DNA-binding modules and transcriptional repressor domains. Nat Commun. Jul. 24, 2012;3:968. doi: 10.1038/ncomms1962.
Cong et al., Multiplex genome engineering using CRISPR/Cas systems. Science. Feb. 15, 2013;339(6121):819-23. doi: 10.1126/science.1231143. Epub Jan. 3, 2013.
Conticello, The AID/APOBEC family of nucleic acid mutators. Genome Biol. 2008;9(6):229 doi: 10.1186/gb-2008-9-6-229. Epub Jun. 17, 2008.
Cornu et al., DNA-binding specificity is a major determinant of the activity and toxicity of zinc-finger nucleases. Mol Ther. Feb. 2008;16(2):352-8. Epub Nov. 20, 2007.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into mammalian cells in vitro and in vivo using a supercharged protein. ACS Chem Biol. Aug. 20, 2010;5(8):747-52. doi: 10.1021/cb1001153.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Ding et al., A TALEN genome-editing system for generating human stem cell-based disease models. Cell Stem Cell. Feb. 7, 203;12(2):238-51. Doi: 10.1016/j.stem.2012.11.011. Epub Dec. 13, 2012.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doyon et al., Enhancing zinc-finger-nuclease activity with improved obligate heterodimeric architectures. Nat Methods. Jan. 2011;8(1):74-9. Doi: 10.1038/nmeth.1539. Epub Dec. 5, 2010.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Edwards et al., Crystal structures of the thi-box riboswitch bound to thiamine pyrophosphate analogs reveal adaptive RNA-small molecule recognition. Structure. Sep. 2006;14(9):1459-68.
Edwards et al., Structural basis for recognition of S-adenosylhomocysteine by riboswitches. RNA. Nov. 2010;16(11):2144-55. doi:10.1261/rna.2341610. Epub Sep. 23, 2010.
Ellington et al., In vitro selection of RNA molecules that bind specific ligands. Nature. Aug. 30, 1990;346(6287):818-22.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Gabriel et al., An unbiased genome-wide analysis of zinc-finger nuclease specificity. Nat Biotechnol. Aug. 7, 2011;29(9):816-23. doi: 10.1038/nbt.1948.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., Crystal structure of a TALE protein reveals an extended N-terminal DNA binding region. Cell Res. Dec. 2012;22(12):1716-20. doi: 10.1038/cr.2012.156. Epub Nov. 13, 2012.
Gardlik et al., Vectors and delivery systems in gene therapy. Med Sci Monit. Apr. 2005;11(4):RA110-21. Epub Mar. 24, 2005.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Genbank Submission; NIH/NCBI, Accession No. J04623. Kita et al., Apr. 26, 1993. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun 11, 2013. 2 pages.

(56) References Cited

OTHER PUBLICATIONS

Genbank Submission; NIH/NCBI, Accession No. NC_018721.1. Feng et al., Jun 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NC_472073.1. Glaser et al., Jun. 27, 2013. 2 pages.
Genbank Submission; NIH/NCBI, Accession No. P42212. Prasher et al., Mar. 19, 2014. 7 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Grundy et al., The L box regulon: lysine sensing by leader RNAs of bacterial lysine biosynthesis genes. Proc Natl Acad Sci USA. Oct. 14, 2003;100(21):12057-62. Epub Oct. 1, 2003.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Directed evolution of an enhanced and highly efficient FokI cleavage domain for zinc finger nucleases. J Mol Biol. Jul. 2, 2010;400(1):96-107. doi: 10.1016/j.jmb.2010.04.060. Epub May 4, 2010.
Guo et al., Protein tolerance to random amino acid change. Proc Natl Acad Sci U S A. Jun. 22, 2004;101(25):9205-10. Epub Jun. 14, 2004.
Guo et al., Structure of Cre recombinase complexed with DNA in a site-specific recombination synapse. Nature. Sep. 4, 1997;389(6646):40-6.
Gupta et al., Zinc finger protein-dependent and -independent contributions to the in vivo off-target activity of zinc finger nucleases. Nucleic Acids Res. Jan. 2011;39(1):381-92. doi: 10.1093/nar/gkq787. Epub Sep. 14, 2010.
Hale et al., RNA-guided RNA cleavage by a CRISPR RNA-Cas protein complex. Cell. Nov. 25, 2009;139(5):945-56. doi: 10.1016/j.cell.2009.07.040.
Hampel et al., Evidence for preorganization of the glmS ribozyme ligand binding pocket. Biochemistry. 2006; 45(25):7861-71.
Händel et al., Expanding or restricting the target site repertoire of zinc-finger nucleases: the inter-domain linker as a major determinant of target site selectivity. Mol Ther. Jan. 2009;17(1):104-11. doi: 10.1038/mt.2008.233. Epub Nov. 11, 2008.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hartung et al., Cre mutants with altered DNA binding properties. J Biol Chem. Sep. 4, 1998;273(36):22884-91.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Heitz et al., Twenty years of cell-penetrating peptides: from molecular mechanisms to therapeutics. Br J Pharmacol. May 2009;157(2):195-206. doi: 10.1111/j.1476-5381.2009.00057.x. Epub Mar. 20, 2009.
Hill et al., Functional analysis of conserved histidines in ADP-glucose pyrophosphorylase from *Escherichia coli*. Biochem Biophys Res Commun. Mar. 17, 1998;244(2):573-7.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hope et al., Cationic lipids, phosphatidylethanolamine and the intracellular delivery of polymeric, nucleic acid-based drugs (review). Mol Membr Biol. Jan.-Mar. 1998;15(1):1-14.
Horvath et al., CRISPR/Cas, the immune system of bacteria and archaea. Science. Jan. 8, 2010;327(5962):167-70. doi: 10.1126/science.1179555.
Houdebine, The methods to generate transgenic animals and to control transgene expression. J Biotechnol. Sep. 25, 2002;98(2-3):145-60.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Huang et al., Heritable gene targeting in zebrafish using customized TALENs. Nat Biotechnol. Aug. 5, 2011;29(8):699-700. doi: 10.1038/nbt.1939.
Huang et al., Long-range pseudoknot interactions dictate the regulatory response in the tetrahydrofolate riboswitch. Proc Natl Acad Sci USA. Sep. 6, 2011;108(36):14801-6. doi: 10.1073/pnas.1111701108. Epub Aug. 22, 2011.
Humbert et al., Targeted gene therapies: tools, applications, optimization. Crit Rev Biochem Mol Biol. May-Jun. 2012;47(3):264-81. doi: 10.3109/10409238.2012.658112.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Ikediobi et al., Mutation analysis of 24 known cancer genes in the NCI-60 cell line set. Mol Cancer Ther. Nov. 2006;5(11):2606-12. Epub Nov. 6, 2006.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

(56) References Cited

OTHER PUBLICATIONS

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jore et al., Structural basis for CRISPR RNA-guided DNA recognition by Cascade. Nat Struct Mal Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kappel et al., Regulating gene expression in transgenic animals. Curr Opin Biotechnol. Oct. 1992;3(5):548-53.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Hybrid restriction enzymes: zinc finger fusions to Fok I cleavage domain. Proc Natl Acad Sci USA. Feb. 6, 1996;93(3):1156-60.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., Transcriptional repression by zinc finger peptides. Exploring the potential for applications in gene therapy. J Biol Chem. Nov. 21, 1997;272(47):29795-800.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub 2Feb. 22, 2009.
Klug et al., Zinc fingers: a novel protein fold for nucleic acid recognition. Cold Spring Harb Symp Quant Biol. 1987;52:473-82.
Komor et al., Programmable editing of a target base in genomic DNA without double-stranded DNA cleavage. Nature. Apr. 20, 2016;533(7603):420-4. doi: 10.1038/nature17946.

Krishna et al., Structural classification of zinc fingers: survey and summary. Nucleic Acids Res. Jan. 15, 2003;31(2):532-50.
Kumar et al., Structural and functional consequences of the mutation of a conserved arginine residue in alphaA and alphaB crystallins. J Biol Chem. Aug. 20, 1999;274(34):24137-41.
Kundu et al., Leucine to praline substitution by SNP at position 197 in Caspase-9 gene expression leads to neuroblastoma: a bioinformatics analysis. 3 Biotech. 2013; 3:225-34.
Kwon et al., Chemical basis of glycine riboswitch cooperativity. RNA. Jan. 2008;14(1):25-34. Epub Nov. 27, 2007.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lazar et al., Transforming growth factor alpha: mutation of aspartic acid 47 and leucine 48 results in different biological activities. Mol Cell Biol. Mar. 1988;8(3):1247-52.
Lee et al., PIK3CA gene is frequently mutated in breast carcinomas and hepatocellular carcinomas. Oncogene. Feb. 17, 2005;24(8):1477-80.
Lee et al., An allosteric self-splicing ribozyme triggered by a bacterial second messenger. Science. Aug. 13, 2010;329(5993):845-8. doi: 10.1126/science.1190713.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Codon 129 polymorphism of the human prion protein influences the kinetics of amyloid formation. J Gen Viral. Aug. 2006;87(Pt 8):2443-9.
Li et al., Current approaches for engineering proteins with diverse biological properties. Adv Exp Med Biol. 2007;620:18-33.
Li et al., Modularly asset al.ed designer TAL effector nucleases for targeted gene knockout and gene replacement in eukaryotes. Nucleic Acids Res. Aug. 2011;39(14):6315-25. doi: 10.1093/nar/gkr188. Epub Mar. 3, 2011.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Liu et al., Fast Calorimetric Sensing of Adenosine and Cocaine Based on a General Sensor Design Involving Aptamers and Nanoparticles. Angew Chem. 2006;118(1):96-100.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Lundberg et al., Delivery of short interfering RNA using endosomolytic cell-penetrating peptides. FASEB J. Sep. 2007;21(11):2664-71. Epub Apr. 26, 2007.
Maeder et al., CRISPR RNA-guided activation of endogenous human genes. Nat Methods. Oct. 2013;10(10):977-9. doi: 10.1038/nmeth.2598. Epub Jul. 25, 2013.

(56) References Cited

OTHER PUBLICATIONS

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Mak et al., The crystal structure of TAL effector PthXo1 bound to its DNA target. Science. Feb. 10, 2012;335(6069):716-9. doi: 10.1126/science.1216211. Epub Jan. 5, 2012.

Mali et al., Cas9 as a versatile tool for engineeringbiology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Mandal et al., A glycine-dependent riboswitch that uses cooperative binding to control gene expression. Science. Oct. 8, 2004;306(5694):275-9.

Mandal et al., Adenine riboswitches and gene activation by disruption of a transcription terminator. Nat Struct Mal Biol. Jan. 2004;11(1):29-35. Epub Dec. 29, 2003.

Mani et al., Design, engineering, and characterization of zinc finger nucleases. Biochem Biophys Res Commun. Sep. 23, 2005;335(2):447-57.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

Meckler et al., Quantitative analysis of TALE-DNA interactions suggests polarity effects. Nucleic Acids Res. Apr. 2013;41(7):4118-28. doi: 10.1093/nar/gkt085. Epub Feb. 13, 2013.

Meng et al., Profiling the DNA-binding specificities of engineered Cys2His2 zinc finger domains using a rapid cell-based method. Nucleic Acids Res. 2007;35(11):e81. Epub May 30, 2007.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Meyer et al., Breathing life into polycations: functionalization with pH-responsive endosomolytic peptides and polyethylene glycol enables siRNA delivery. J Am Chem Soc. Mar. 19, 2008;130(10:3272-3. doi: 10.1021/ja710344v. Epub Feb. 21, 2008.

Meyer et al., Confirmation of a second natural preQ1 aptamer class in *Streptococcaceae* bacteria. RNA. Apr. 2008;14(4):685-95. doi: 10.1261/rna.937308. Epub Feb. 27, 2008.

Midoux et al., Chemical vectors for gene delivery: a current review on polymers, peptides and lipids containing histidine or imidazole as nucleic acids carriers. Br J Pharmacal. May 2009;157(2):166-78. doi: 10.1111/j.1476-5381.2009.00288.x.

Miller et al., A Tale nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PloS One. 2012;7(5):e37877. Doi: 10.1371/journal.pone.0037877. Epub May. 24, 2012.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5.

Morbitzer et al., Asset al.y of custom TALE-type DNA binding domains by modular cloning. Nucleic Acids Res. Jul. 2011;39(13):5790-9. doi: 10.1093/nar/gkr151. Epub Mar. 18, 2011.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mullins et al., Transgenesis in nonmurine species. Hypertension. Oct. 1993;22(4):630-3.

Murphy, Phage recombinases and their applications. Adv Virus Res. 2012;83:367-414. doi: 10.1016/B978-0-12-394438-2.00008-6. Review.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nahvi et al., Coenzyme B12 riboswitches are widespread genetic control elements in prokaryotes. Nucleic Acids Res. Jan. 2, 2004;32(1):143-50.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Neel et al., Riboswitches: Classification, function and in silico approach, International Journal of Pharma Sciences and Research. 2010;1(9):409-420.

Ni et al., Nucleic acid aptamers: clinical applications and promising new horizons. Curr Med Chem. 2011;18(27):4206-14. Review.

Nishida et al., Targeted nucleotide editing using hybrid prokaryotic and vertebrate adaptive immune systems. Science. Sep. 16, 2016;353(6305). pii: aaf8729. doi: 10.1126/science.aaf8729. Epub Aug. 4, 2016.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nomura et al., Synthetic mammalian riboswitches based on guanine aptazyme. Chem Commun.(CAMB). Jul. 21, 2012;48(57):7215-7. doi: 10.1039/c2cc33140c. Epub Jun. 13, 2012.

Noris et al., A phenylalanine-55 to serine amino-acid substitution in the human glycoprotein IX leucine-rich repeat is associated with Bernard-Soulier syndrome. Br J Haematol. May 1997;97(2):312-20.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

Olorunniji et al., Synapsis and catalysis by activated T3 resolvase mutants. Nucleic Acids Res. Dec. 2008;36(22):7181-91. doi: 10.1093/nar/gkn885. Epub Nov. 10, 2008.

Osborn et al., TALEN-based gene correction for epidermolysis bullosa. Mol Ther. Jun. 2013;21(6):1151-9. doi: 10.1038/mt.2013.56. Epub Apr. 2, 2013.

Pabo et al., Design and selection of novel Cys2His2 zinc finger proteins. Annu Rev Biochem. 2001;70:313-40.

Pan et al., Biological and biomedical applications of engineered nucleases. Mol Biotechnol. Sep. 2013;55(1):54-62. doi: 10.1007/s12033-012-9613-9.

(56) References Cited

OTHER PUBLICATIONS

Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA—programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Petek et al., Frequent endonuclease cleavage at off-target locations in vivo. Mol Ther. May 2010;18(5):983-6. Doi: 10.1038/mt.2010.35. Epub Mar. 9, 2010.
Pham et al., Reward versus risk: DNA cytidine deaminases triggering immunity and disease. Biochemistry. Mar. 1, 2005;44(8):2703-15.
Phillips, The challenge of gene therapy and DNA delivery. J Pharm Pharmacol. Sep. 2001;53(9):1169-74.
Poller et al., A leucine-to-proline substitution causes a defective alpha 1-antichymotrypsin allele associated with familial obstructive lung disease. Genomics. Sep. 1993;17(3):740-3.
Porteus, Design and testing of zinc finger nucleases for use in mammalian cells. Methods Mol Biol. 2008;435:47-61. doi: 10.1007/978-1-59745-232-8_4.
Proudfoot et al., Zinc finger recombinases with adaptable DNA sequence specificity. PLoS One. Apr. 29, 2011;6(4):e19537. doi: 10.1371/journal.pone.0019537.
Putney et al., Improving protein therapeutics with sustained-release formulations. Nat Biotechnol. Feb. 1998;16(2):153-7.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular asset.y of engineered zinc fingers. Nat Methods. May 2008;5(5):374-5. Doi: 10.1038/nmeth0508-374.
Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.

Reynaud et al., What role for AID: mutator, or asset al.er of the immunoglobulin mutasome? Nat Immunol. Jul. 2003;4(7):631-8.
Rongrong et al., Effect of deletion mutation on the recombination activity of Cre recombinase. Acta Biochim Pol. 2005;52(2):541-4. Epub May 15, 2005.
Roth et al., A riboswitch selective for the queuosine precursor preQ1 contains an unusually small aptamer domain. Nat Struct Mol Biol. Apr. 2007;14(4):308-17. Epub Mar. 25, 2007.
Sage et al., Proliferation of functional hair cells in vivo in the absence of the retinoblastoma protein. Science. Feb. 18, 2005;307(5712):1114-8. Epub Jan. 13, 2005.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang, Prospects for transgenesis in the chick. Mech Dev. Sep. 2004;121(9):1179-86.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Sapranauskas et al., The *Streptococcus* thermophilus CRISPR/Cas system provides immunity in *Escherichia coli*. Nucleic Acids Res. Nov. 2011;39(21):9275-82. doi: 10.1093/nar/gkr606. Epub Aug. 3, 2011.
Sashital et al., Mechanism of foreign DNA selection in a bacterial adaptive immune system. Mol Cell. Jun. 8, 2012;46(5):606-15. doi: 10.1016/j.molce1.2012.03.020. Epub Apr. 19, 2012.
Schriefer et al., Low pressure DNA shearing: a method for random DNA sequence analysis. Nucleic Acids Res. Dec. 25, 1990;18(24):7455-6.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Segal et al., Evaluation of a modular strategy for the construction of novel polydactyl zinc finger DNA-binding proteins. Biochemistry. Feb. 25, 2003;42(7):2137-48.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Bioteclmiques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

(56) References Cited

OTHER PUBLICATIONS

Serganov et al., Structural basis for discriminative regulation of gene expression by adenine-and guanine-sensing mRNAs. Chem Biol. Dec. 2004;11(12):1729-41.

Serganov et al., Structural basis for gene regulation by a thiamine pyrophosphate-sensing riboswitch. Nature. Jun. 29, 2006;441(7097):1167-71. Epub May 21, 2006.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shaikh et al., Chimeras of the Flp and Cre recombinases: tests of the mode of cleavage by Flp and Cre. J Mol Biol. Sep. 8, 2000;302(1):27-48.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Shimizu et al., Adding fingers to an engineered zinc finger nuclease can reduce activity. Biochemistry. Jun. 7, 2011;50(22):5033-41. doi: 10.1021/bi200393g. Epub May 11, 2011.

Siebert et al., An improved PCR method for walking in uncloned genomic DNA. Nucleic Acids Res. Mar. 25, 1995;23(6):1087-8.

Skretas et al., Regulation of protein activity with small-molecule-controlled inteins. Protein Sci. Feb. 2005;14(2):523-32. Epub Jan. 4, 2005.

Smith et al., Diversity in the serine recombinases. Mol Microbiol. Apr. 2002;44(2):299-307. Review.

Song et al., Antibody mediated in vivo delivery of small interfering RNAs via cell-surface receptors. Nat Biotechnol. Jun. 2005;23(6):709-17. Epub May 22, 2005.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sudarsan et al., An mRNA structure in bacteria that controls gene expression by binding lysine. Genes Dev. Nov. 1, 2003;17(21):2688-97.

Sudarsan et al., Riboswitches in eubacteria sense the second messenger cyclic di-GMP. Science. Jul. 18, 2008;321(5887):411-3. doi: 10.1126/science.1159519.

Suess et al., A theophylline responsive riboswitch based on helix slipping controls gene expression in vivo. Nucleic Acids Res. Mar. 5, 2004,;32(4):1610-4.

Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

Szczepek et al., Structure-based redesign of the dimerization interface reduces the toxicity of zinc-finger nucleases. Nat Biotechnol. Jul. 2007;25(7):786-93. Epub Jul. 1, 2007.

Tebas et al., Gene editing of CCR5 in autologous CD4 T cells of persons infected with HIV. N. Engl J Med. Mar. 6, 2014;370(10):901-10. doi: 10.1056/NEJMoa1300662.

Tessarollo et al., Targeted mutation in the neurotrophin-3 gene results in loss of muscle sensory neurons. Proc Natl Acad Sci U S A. Dec. 6, 1994;91(25):11844-8.

Tesson et al., Knockout rats generated by embryo microinjection of TALENs. Nat Biotechnol. Aug. 5, 2011;29(8):695-6. doi: 10.1038/nbt.1940.

Thompson et al., Cellular uptake mechanisms and endosomal trafficking of supercharged proteins. Chem Biol. Jul. 27, 2012;19(7):831-43. doi: 10.1016/j.chembiol.2012.06.014.

Thompson et al., Engineering and identifying supercharged proteins for macromolecule delivery into mammalian cells. Methods Enzymol. 2012;503:293-319. doi: 10.1016/B978-0-12-396962-0.00012-4.

Thorpe et al., Functional correction of episomal mutations with short DNA fragments and RNA-DNA oligonucleotides. J Gene Med. Mar.-Apr. 2002;4(2):195-204.

Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.

Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.

Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.

Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.

Tyszkiewicz et al., Activation of protein splicing with light in yeast. Nat Methods. Apr. 2008;5(4):303-5. doi: 10.1038/nmeth.1189. Epub Feb. 13, 2008.

Uniprot Submission; UniProt, Accession No. P01011. Last modified Jun. 11, 2014, version 2. 15 pages.

Uniprot Submission; UniProt, Accession No. P01011. Last modified Sep. 18, 2013, version 2. 15 pages.

Uniprot Submission; UniProt, Accession No. P04264. Last modified Jun. 11, 2014, version 6. 15 pages.

Uniprot Submission; UniProt, Accession No. P04275. Last modified Jul. 9, 2014, version 107. 29 pages.

Urnov et al., Genome editing with engineered zinc finger nucleases. Nat Rev Genet. Sep. 2010;11(9):636-46. doi: 10.1038/nrg2842.

Urnov et al., Highly efficient endogenous human gene correction using designed zinc-finger nucleases. Nature. Jun. 2, 2005;435(7042):646-51. Epub Apr. 3, 2005.

Van Duyne et al., Teaching Cre to follow directions. Proc Natl Acad Sci U S A. Jan. 6, 2009;106(1):4-5. doi: 10.1073/pnas.0811624106. Epub Dec. 31, 2008.

Vanamee et al., FokI requires two specific DNA sites for cleavage. J Mol Biol. May 25, 2001;309(1):69-78.

Vitreschak et al., Regulation of the vitamin B12 metabolism and transport in bacteria by a conserved RNA structural element. RNA. Sep. 2003;9(9):1084-97.

Wacey et al., Disentangling the perturbational effects of amino acid substitutions in the DNA-binding domain of p53. Hum Genet. Jan. 1999;104(1):15-22.

Wadia et al., Modulation of cellular function by TAT mediated transduction of full length proteins. Curr Protein Pept Sci. Apr. 2003;4(2):97-104.

Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.

Wah et al., Structure of FokI has implications for DNA cleavage. Proc Natl Acad Sci U S A. Sep. 1, 1998;95(18):10564-9.

Wang et al., Efficient delivery of genome-editing proteins using bioreducible lipid nanoparticles. Proc Natl Acad Sci U S A. Feb. 29, 2016. pii: 201520244. [Epub ahead of print].

Wang et al., Genetic screens in human cells using the CRISPR-Cas9 system. Science. Jan. 3, 2014;343(6166):80-4. doi: 10.1126/science.1246981. Epub Dec. 12, 2013.

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.

Wang et al., Riboswitches that sense S-adenosylhomocysteine and activate genes involved in coenzyme recycling. Mol Cell. Mar. 28, 2008;29(6):691-702. doi: 10.1016/j.mokel.2008.01.012.

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.

Weber et al., Asset al.y of designer TAL effectors by Golden Gate cloning. PLoS One. 2011;6(5):e19722. doi:10.1371/journal.pone. 0019722. Epub May 19, 2011.

Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.

(56) References Cited

OTHER PUBLICATIONS

Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Winkler et al., An mRNA structure that controls gene expression by binding FMN. Proc Natl Acad Sci U S A. Dec. 10, 2002;99(25):15908-13. Epub Nov. 27, 2002.
Winkler et al., An mRNA structure that controls gene expression by binding S-adenosylmethionine. Nat Struct Biol.Sep. 2003;10(9):701-7. Epub Aug. 10, 2003.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Yang et al., Genome editing with targeted deaminases. BioRxiv. Preprint. First poted online Jul. 28, 2016.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Zelphati et al., Intracellular delivery of proteins with a new lipid-mediated delivery system. J Biol Chem. Sep. 14, 2001;276(37):35103-10. Epub Jul. 10, 2001.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zimmermann et al., Molecular interactions and metal binding in the theophylline-binding core of an RNA aptamer. RNA. May 2000;6(5):659-67.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Bitinaite et al., FokI dimerization is required for DNA cleavage. Proc Natl Acad Sci U S A. Sep. 1, 1998;95(18):10570-5.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Cox et al., Conditional gene expression in the mouse inner ear using Cre-ioxP. J Assoc Res Otolaryngol. Jun. 2012;13(3):295-322. doi: 10.1007/s10162-012-0324-5. Epub Apr. 24, 2012.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.
International Search Report and Written Opinion for PCT/US2017/046144, dated Oct. 10, 2017.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Rees et al., Improving the DNA specificity and applicability of base editing through protein engineering and protein delivery. Nat Commun. Jun. 6, 2017;8:15790. doi: 10.1038/ncomms15790.
Sclimenti et al., Directed evolution of a recombinase for improved genomic integration at a native human sequence. Nucleic Acids Res. Dec. 15, 2001;29(24):5044-51.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Wang et al., Recombinase technology: applications and possibilities. Plant Cell Rep. Mar. 2011;30(3):267-85. doi: 10.1007/s00299-010-0938-1. Epub Oct. 24, 2010.
Yuan et al., Tetrameric structure of a serine integrase catalytic domain. Structure. Aug. 6, 2008;16(8):1275-86. doi: 10.1016/j.str.2008.04.018.
Zhang et al., Programmable base editing of zebrafish genome using a modified CRISPR/Cas9 system. Nat Commun. Jul. 25, 2017;8(1):118. doi: 10.1038/s41467-017-00175-6.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Bolotin et al., Clustered regularly interspaced short palindrome repeats (CRISPRs) have spacers of extrachromosomal origin. Microbiology. Aug. 2005;151(Pt 8):2551-61.
Brouns et al., Small CRISPR RNAs guide antiviral defense in prokaryotes. Science. Aug. 15, 2008;321(5891):960-4. doi: 10.1126/science.1159689.
Fukui et al., DNA Mismatch Repair in Eukaryotes and Bacteria. J Nucleic Acids. Jul. 27, 2010;2010. pii: 260512. doi: 10.4061/2010/260512.
Garneau et al., The CRISPR/Cas bacterial immune system cleaves bacteriophage and plasmid DNA. Nature. Nov. 4, 2010;468(7320):67-71. doi: 10.1038/nature09523.
Heller et al., Replisome assembly and the direct restart of stalled replication forks. Nat Rev Mol Cell Biol. Dec. 2006;7(12):932-43. Epub 2006 Nov 8.

(56) References Cited

OTHER PUBLICATIONS

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Jansen et al., Identification of genes that are associated with DNA repeats in prokaryotes. Mol Microbiol. Mar. 2002;43(6):1565-75.

Kunz et al., DNA Repair in mammalian cells: Mismatched repair: variations on a theme. Cell Mol Life Sci. Mar. 2009;66(6):1021-38. doi: 10.1007/s00018-009-8739-9.

Lieber et al., Mechanism and regulation of human non-homologous DNA end-joining. Nat Rev Mol Cell Biol. Sep. 2003;4(9):712-20.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Evolution and classification of the CRISPR-Cas systems. Nat Rev Microbiol. Jun. 2011;9(6):467-77. doi: 10.1038/nrmicro2577. Epub May 9, 2011.

Marraffini et al., CRISPR interference limits horizontal gene transfer in *Staphylococci* by targeting DNA. Science. Dec. 19, 2008;322(5909):1843-5. doi: 10.1126/science.1165771.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Mojica et al., Intervening sequences of regularly spaced prokaryotic repeats derive from foreign genetic elements. J Mol Evol. Feb. 2005;60(2):174-82.

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Ray et al., Homologous recombination: ends as the means. Trends Plant Sci. Oct. 2002;7(10):435-40.

Reyon et al., FLASH assembly of TALENs for high-throughput genome editing. Nat Biotechnol. May 2012;30(5):460-5. doi: 10.1038/nbt.2170.

Richter et al., Function and regulation of clustered regularly interspaced short palindromic repeats (CRISPR)/CRISPR associated (Cas) systems. Viruses. Oct. 19, 2012;4(10):2291-311. doi: 10.3390/v4102291.

Schellenberger et al., A recombinant polypeptide extends the in vivo half-life of peptides and proteins in a tunable manner. Nat Biotechnol. Dec. 2009;27(12):1186-90. doi: 10.1038/nbt.1588.

Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.

Stephens et al., The landscape of cancer genes and mutational processes in breast cancer. Nature Jun. 2012;486:400-404. doi:10.1038/nature11017.

Vagner et al., Efficiency of homologous DNA recombination varies along the Bacillus subtilis chromosome. J Bacteriol. Sep. 1988;170(9):3978-82.

Wiedenheft et al., RNA-guided genetic silencing systems in bacteria and archaea. Nature. Feb. 15, 2012;482(7385):331-8. doi: 10.1038/nature10886. Review.

\* cited by examiner

EMX1:          GAGTC$_5$C$_6$GAGCAGAAGAAGAAGGG
FANCF:         GGAATC$_6$C$_7$C$_8$TTC$_{11}$TGCAGCACCTGG
HEK293 site 2: GAAC$_4$AC$_6$AAAGCATAGACTGCGGG
HEK293 site 3: GGCC$_4$C$_5$AGACTGAGCACGTGATGG
HEK293 site 4: GGCAC$_5$TGCGGCTGGAGGTCCGGG
RNF2:          GTC$_3$ATC$_6$TTAGTC$_{12}$ATTACCTGAGG

APOE4 Cys112Arg:   5'-GGAGGACGTGC$_{11}$GCGGCCGCCTGG
APOE4 Cys158Arg:   5'-GAAGC$_6$GCCTGGCAGTGTACCAGG
CTNNB1 Thr41Ala:   5'-CTGTGGC$_7$AGTGGCACCAGAATGG
HRAS Gln61Arg:     5'-CCTCCC$_6$GGCCGGCGGTATCCAGG
p53 Tyr163Cys:     5'-GCTTGC$_9$AGATGGCCATGGCGCGG
p53 Tyr236Cys:     5'-ACACATGC$_8$AGTTGTAGTGGATGG
p53 Asn239Asp:     5'-TGTC$_4$ACACATGTAGTTGTAGTGG

FIGURE 16A

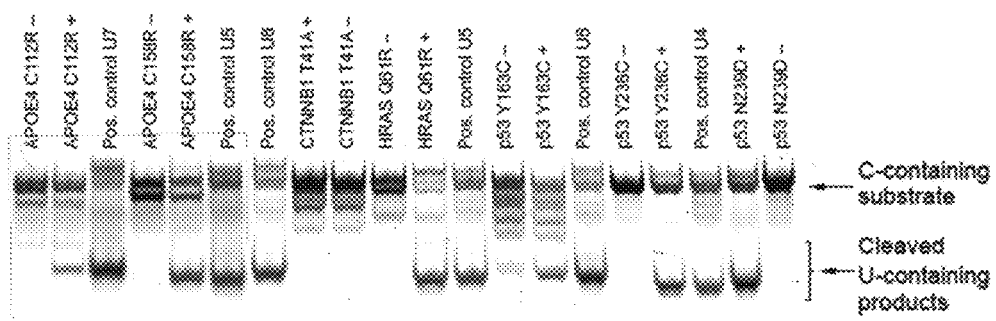

FIGURE 16B

Protospacer and PAM sequence:  5'-TTCCCCCCCCGATTTATTTATGG-3'

| Sequence | % of total reads |
|---|---|
| CCCCCCCC | 62.4 |
| TTTTTTCC | 18.2 |
| TTTTTTTC | 13.4 |
| TTTTTTTT | 3.3 |
| TCCCCCCC | 0.8 |
| CCCCTTCC | 0.3 |
| CCCTTTCC | 0.3 |
| TTTTTCCC | 0.3 |
| CCCCTCCC | 0.3 |

FIGURE 17

EMX1:         GAGTC$_5$C$_6$GAGCAGAAGAAGAAGGG
FANCF:        GGAATC$_6$C$_7$C$_8$TTC$_{11}$TGCAGCACCTGG
HEK293 site 2: GAAC$_4$AC$_6$AAAGCATAGACTGCGGG
HEK293 site 3: GGCC$_4$C$_5$AGACTGAGCACGTGATGG
HEK293 site 4: GGCAC$_5$TGCGGCTGGAGGTCCGGG
RNF2:         GTC$_3$ATC$_6$TTAGTCATTACCTGAGG

FIGURE 18A

| EMX1 | C$_5$ | C$_6$ |
|---|---|---|
| NBE1 | 6.2% | 6.5% |
| NBE1 + UGI | 9.7% | 10.1% |
| NBE2 | 8.0% | 8.7% |

FIGURE 18B

| FANCF | C$_6$ | C$_7$ | C$_8$ | C$_{11}$ |
|---|---|---|---|---|
| NBE1 | 3.7% | 3.2% | 3.4% | 2.4% |
| NBE1 + UGI | 7.5% | 7.6% | 7.5% | 1.6% |
| NBE2 | 4.7% | 4.6% | 4.6% | 0.8% |

FIGURE 18C

| HEK293 site 2 | C$_4$ | C$_6$ |
|---|---|---|
| NBE1 | 0.4% | 0.4% |
| NBE1 + UGI | 1.6% | 2.6% |
| NBE2 | 3.4% | 5.9% |

FIGURE 18D

| HEK293 site 3 | $C_4$ | $C_6$ |
|---|---|---|
| NBE1 | 2.0% | 1.9% |
| NBE1 + UGI | 6.5% | 6.7% |
| NBE2 | 10.0% | 12.5% |

FIGURE 18E

| HEK293 site 4 | $C_5$ |
|---|---|
| NBE1 | 1.4% |
| NBE1 + UGI | 5.4% |
| NBE2 | 8.2% |

FIGURE 18F

| RNF2 | $C_3$ | $C_6$ |
|---|---|---|
| NBE1 | 0.7% | 1.4% |
| NBE1 + UGI | 3.4% | 3.9% |
| NBE2 | 2.5% | 3.7% |

FIGURE 18G

| Non-protospacer Cs | C | T |
|---|---|---|
| untreated | 99.93% | 0.03% |
| NBE1 | 99.95% | 0.03% |
| NBE1 + UGI | 99.91% | 0.06% |
| NBE2 | 99.92% | 0.04% |

| Non-protospacer Cs | C (%) | T (%) |
|---|---|---|
| untreated | 99.94 | 0.04 |
| NBE1 | 99.92 | 0.05 |
| NBE2 | 99.92 | 0.05 |
| NBE3 | 99.94 | 0.03 |

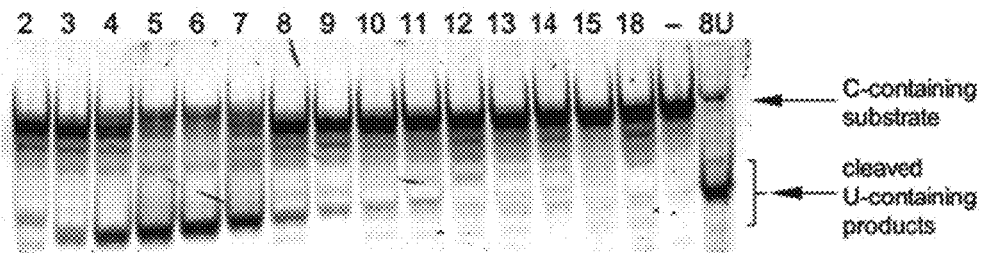
FIGURE 36D
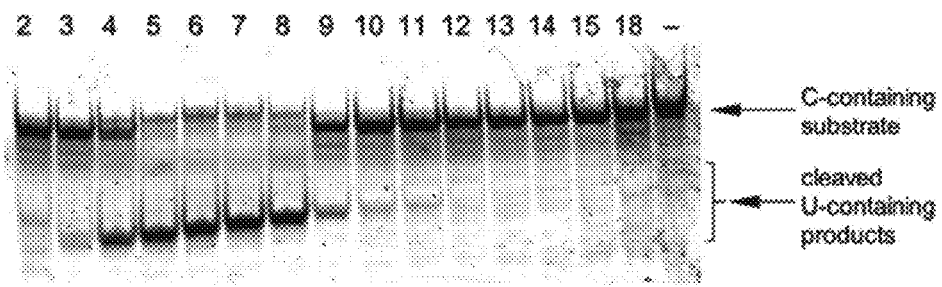
FIGURE 36E
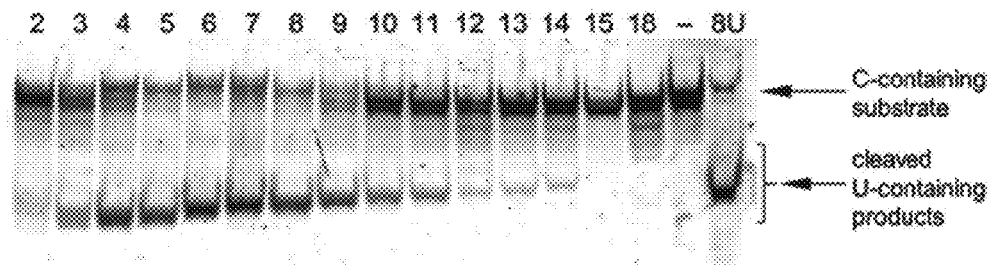
FIGURE 36F
```
EMX1:          GAGTC₅C₆GAGCAGAAGAAGAAGGG
FANCF:         GGAATC₆C₇C₈TTC₁₁TGCAGCACCTGG
HEK293 site 2: GAAC₄AC₉AAAGCATAGACTGCGGG
HEK293 site 3: GGCC₄C₅AGACTGAGCACGTGATGG
HEK293 site 4: GGCAC₅TGCGGCTGGAGGTCCGGG
RNF2:          GTC₃ATC₆TTAGTC₁₂ATTACCTGAGG
```
FIGURE 37A

FIGURE 37B

| non-protospacer C/Gs | average C/G (%) | average T/A (%) | lowest T/A (%) | highest T/A (%) |
|---|---|---|---|---|
| untreated | 99.95 ± 0.14 | 0.02 ± 0.02 | 0.00 | 2.44 |
| BE1 | 99.95 ± 0.24 | 0.03 ± 0.03 | 0.00 | 1.64 |
| BE2 | 99.95 ± 0.13 | 0.03 ± 0.03 | 0.00 | 1.92 |
| BE3 | 99.97 ± 0.09 | 0.02 ± 0.02 | 0.00 | 2.52 |

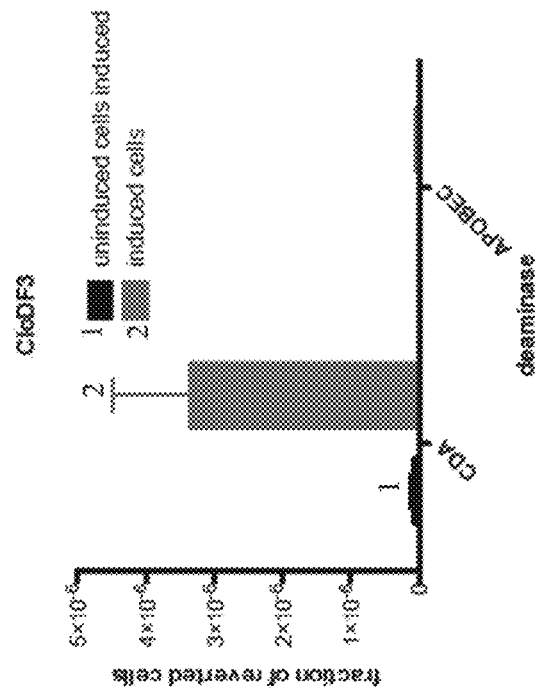
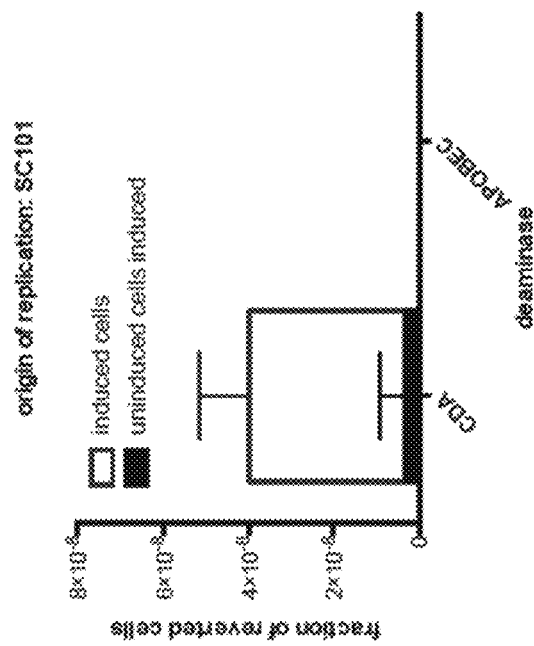
FIGURE 49

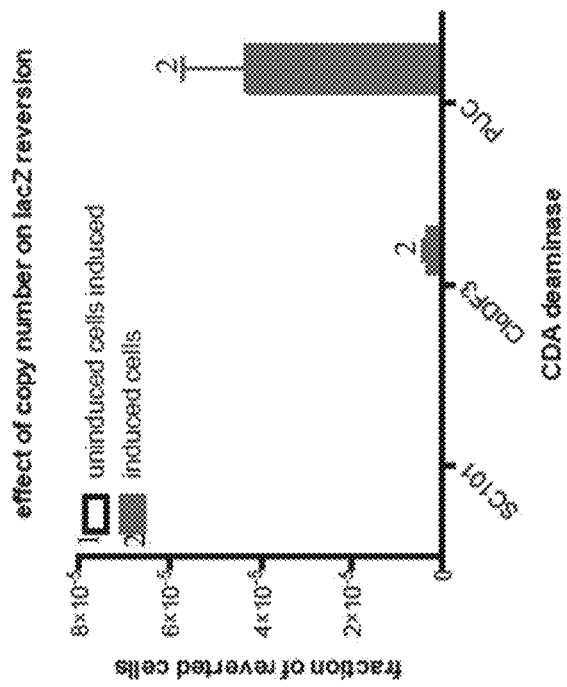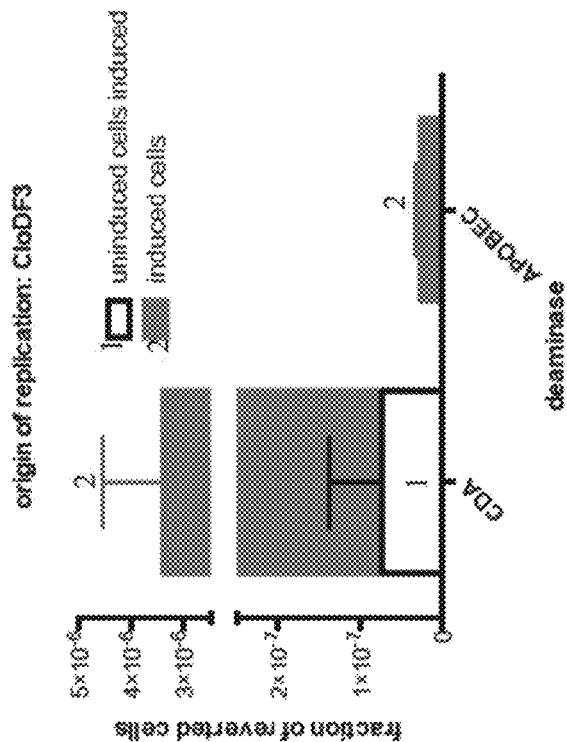
FIGURE 49 (CONTINUED)

FIGURE 50

Row 1: CDA-dCas9 + selection plasmid (chlor$^S$)

Row 2: CDA-dCas9 + pos. control selection (chlor$^R$)

Row 3: rAPOBEC-dCas9 + selection plasmid (chlor$^S$)

Row 4: rAPOBEC-dCas9 + pos. control selection (chlor$^R$)

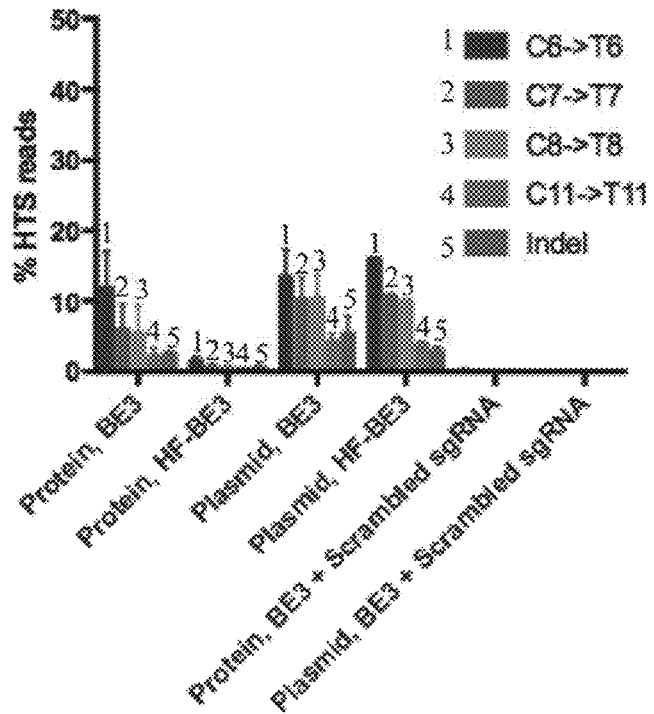
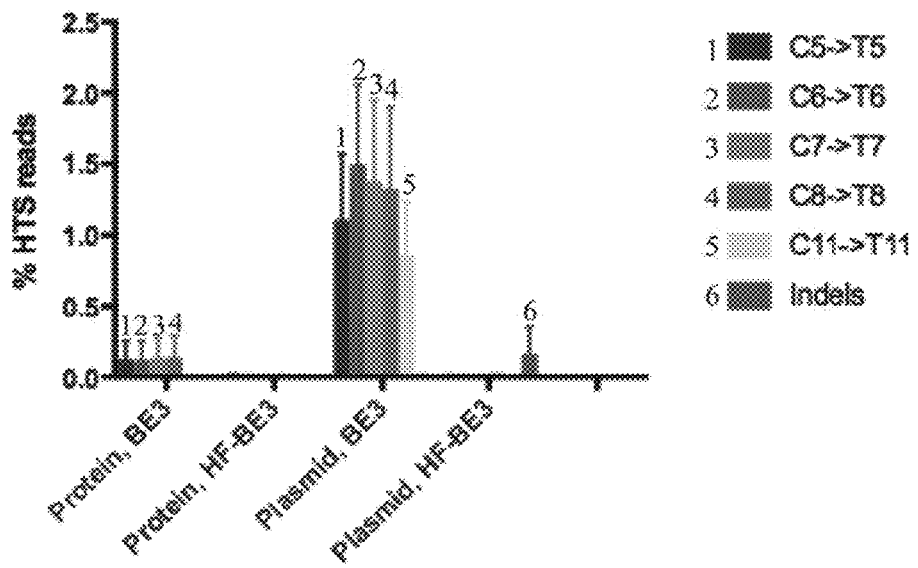
FIGURE 78

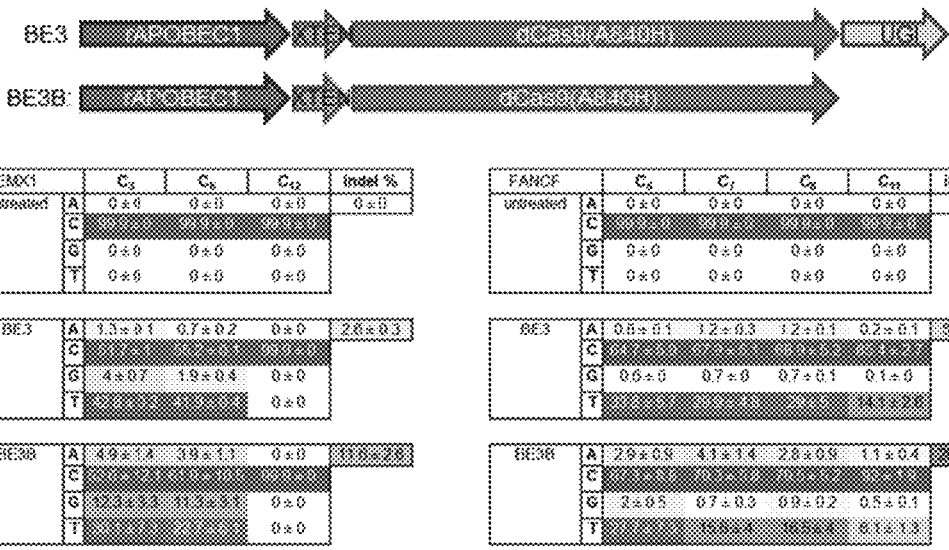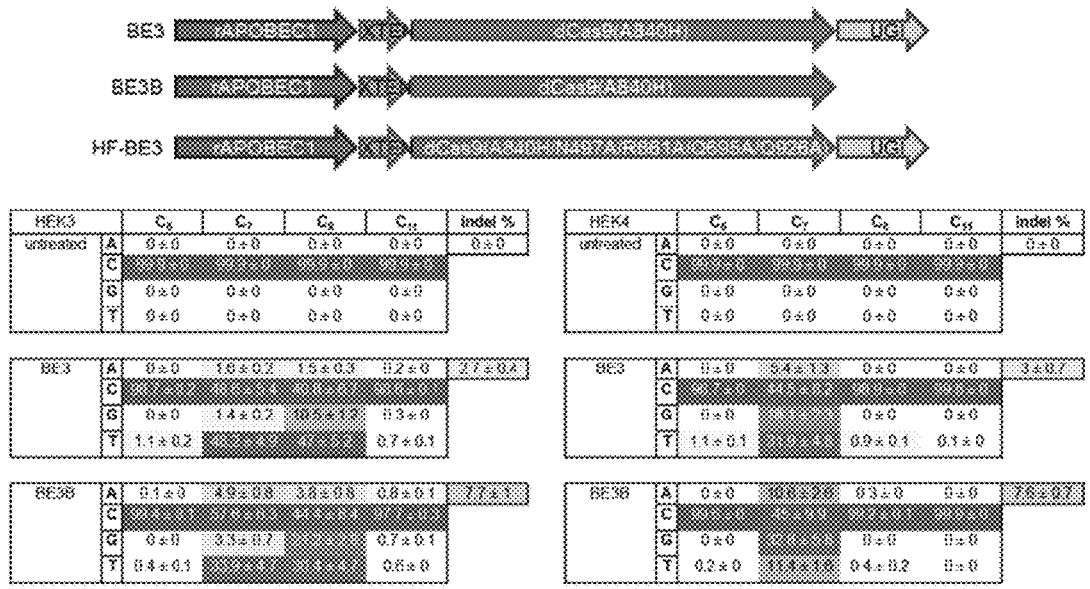
FIGURE 91

| Species | PAM | Base editor | Reference |
|---|---|---|---|
| S. pyogenes | NGG | BE3 | Wild-type |
| | NGA | VQR, EQR BE3 | Ref#7 |
| | NGCG | VRER BE3 | Ref#7 |
| S. aureus | NNGRRT | SaBE3 | Wild-type |
| | NNNRRT | SaKKHBE3 | Ref#8 |

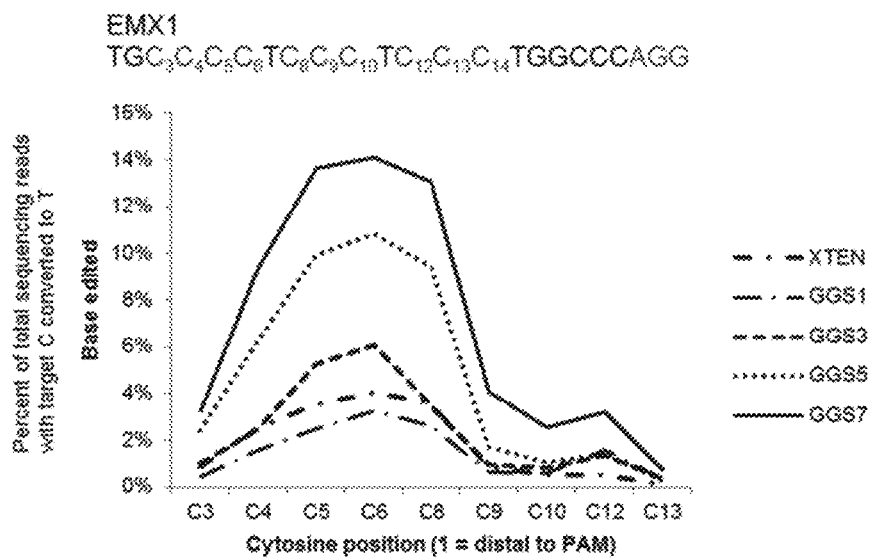
FIGURE 96
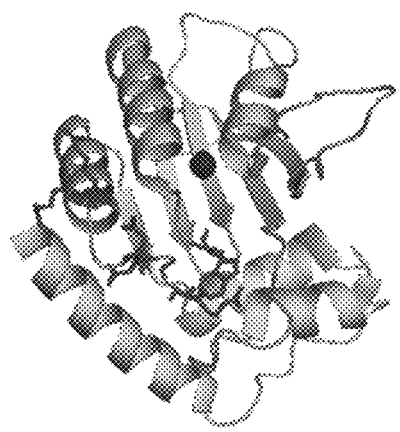
FIGURE 97A
| APOBEC1 mutation | APOBEC3G mutation | Reference |
|---|---|---|
| R126A | R320A | #9,10 |
| R126E | R320E | #9,10 |
| W90A | W285A | #9,10 |
| W90Y | W285Y | This work |
| R132E | R326E | This work |
FIGURE 97B

US 10,167,457 B2

NUCLEOBASE EDITORS AND USES THEREOF

RELATED APPLICATIONS

This application claims priority under 35 U.S.C. § 119(e) to U.S. provisional patent applications, U.S. Ser. No. 62/245,828 filed Oct. 23, 2015, U.S. Ser. No. 62/279,346 filed Jan. 15, 2016, U.S. Ser. No. 62/311,763 filed Mar. 22, 2016, U.S. Ser. No. 62/322,178 filed Apr. 13, 2016, U.S. Ser. No. 62/357,352 filed Jun. 30, 2016, U.S. Ser. No. 62/370,700 filed Aug. 3, 2016, U.S. Ser. No. 62/398,490 filed Sep. 22, 2016, U.S. Ser. No. 62/408,686 filed Oct. 14, 2016, and U.S. Ser. No. 62/357,332 filed Jun. 30, 2016; each of which is incorporated herein by reference.

GOVERNMENT SUPPORT

This invention was made with government support under grant number R01 EB022376 (formerly R01 GM065400) awarded by the National Institutes of Health, under training grant numbers F32 GM 112366-2 and F32 GM 106601-2 awarded by the National Institutes of Health, and Harvard Biophysics NIH training grant T32 GM008313 awarded by the National Institutes of Health. The government has certain rights in the invention.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases.[1] An ideal nucleic acid editing technology possesses three characteristics: (1) high efficiency of installing the desired modification; (2) minimal off-target activity; and (3) the ability to be programmed to edit precisely any site in a given nucleic acid, e.g., any site within the human genome.[2] Current genome engineering tools, including engineered zinc finger nucleases (ZFNs),[3] transcription activator like effector nucleases (TALENs),[4] and most recently, the RNA-guided DNA endonuclease Cas9,[5] effect sequence-specific DNA cleavage in a genome. This programmable cleavage can result in mutation of the DNA at the cleavage site via non-homologous end joining (NHEJ) or replacement of the DNA surrounding the cleavage site via homology-directed repair (HDR).[6,7]

One drawback to the current technologies is that both NHEJ and HDR are stochastic processes that typically result in modest gene editing efficiencies as well as unwanted gene alterations that can compete with the desired alteration.[8] Since many genetic diseases in principle can be treated by effecting a specific nucleotide change at a specific location in the genome (for example, a C to T change in a specific codon of a gene associated with a disease),[9] the development of a programmable way to achieve such precision gene editing would represent both a powerful new research tool, as well as a potential new approach to gene editing-based human therapeutics.

SUMMARY OF THE INVENTION

The clustered regularly interspaced short palindromic repeat (CRISPR) system is a recently discovered prokaryotic adaptive immune system[10] that has been modified to enable robust and general genome engineering in a variety of organisms and cell lines.[11] CRISPR-Cas (CRISPR associated) systems are protein-RNA complexes that use an RNA molecule (sgRNA) as a guide to localize the complex to a target DNA sequence via base-pairing.[12] In the natural systems, a Cas protein then acts as an endonuclease to cleave the targeted DNA sequence.[13] The target DNA sequence must be both complementary to the sgRNA, and also contain a "protospacer-adjacent motif" (PAM) at the 3'-end of the complementary region in order for the system to function.[14]

Among the known Cas proteins, S. pyogenes Cas9 has been mostly widely used as a tool for genome engineering.[15] This Cas9 protein is a large, multi-domain protein containing two distinct nuclease domains. Point mutations can be introduced into Cas9 to abolish nuclease activity, resulting in a dead Cas9 (dCas9) that still retains its ability to bind DNA in a sgRNA-programmed manner.[16] In principle, when fused to another protein or domain, dCas9 can target that protein to virtually any DNA sequence simply by co-expression with an appropriate sgRNA.

The potential of the dCas9 complex for genome engineering purposes is immense. Its unique ability to bring proteins to specific sites in a genome programmed by the sgRNA in theory can be developed into a variety of site-specific genome engineering tools beyond nucleases, including transcriptional activators, transcriptional repressors, histone-modifying proteins, integrases, and recombinases.[11] Some of these potential applications have recently been implemented through dCas9 fusions with transcriptional activators to afford RNA-guided transcriptional activators,[17,18] transcriptional repressors,[16,19,20] and chromatin modification enzymes.[21] Simple co-expression of these fusions with a variety of sgRNAs results in specific expression of the target genes. These seminal studies have paved the way for the design and construction of readily programmable sequence-specific effectors for the precise manipulation of genomes.

Significantly, 80-90% of protein mutations responsible for human disease arise from the substitution, deletion, or insertion of only a single nucleotide.[6] Most current strategies for single-base gene correction include engineered nucleases (which rely on the creation of double-strand breaks, DSBs, followed by stochastic, inefficient homology-directed repair, HDR), and DNA-RNA chimeric oligonucleotides.[22] The latter strategy involves the design of a RNA/DNA sequence to base pair with a specific sequence in genomic DNA except at the nucleotide to be edited. The resulting mismatch is recognized by the cell's endogenous repair system and fixed, leading to a change in the sequence of either the chimera or the genome. Both of these strategies suffer from low gene editing efficiencies and unwanted gene alterations, as they are subject to both the stochasticity of HDR and the competition between HDR and non-homologous end-joining, NHEJ.[23-25] HDR efficiencies vary according to the location of the target gene within the genome,[26] the state of the cell cycle,[27] and the type of cell/tissue.[28] The development of a direct, programmable way to install a specific type of base modification at a precise location in genomic DNA with enzyme-like efficiency and no stochasticity therefore represents a powerful new approach to gene editing-based research tools and human therapeutics.

Some aspects of the disclosure are based on the recognition that certain configurations of a dCas9 domain, and a cytidine deaminase domain fused by a linker are useful for efficiently deaminating target cytidine residues. Other aspects of this disclosure relate to the recognition that a nucleobase editing fusion protein with a cytidine deaminase domain fused to the N-terminus of a nuclease inactive Cas9

(dCas9) via a linker was capable of efficiently deaminating target nucleic acids in a double stranded DNA target molecule. See for example, Examples 3 and 4 below, which demonstrate that the fusion proteins, which are also referred to herein as base editors, generate less indels and more efficiently deaminate target nucleic acids than other base editors, such as base editors without a UGI domain. In some embodiments, the fusion protein comprises a nuclease-inactive Cas9 (dCas9) domain and an apolipoprotein B mRNA-editing complex 1 (APOBEC1) deaminase domain, where the deaminase domain is fused to the N-terminus of the dCas9 domain via a linker comprising the amino acid sequence SGSETPGTSESATPES (SEQ ID NO: 7). In some embodiments, the nuclease-inactive Cas9 (dCas9) domain of comprises the amino acid sequence set forth in SEQ ID NO: 263. In some embodiments, the deaminase is rat APOBEC1 (SEQ ID NO: 284). In some embodiments, the deaminase is human APOBEC1 (SEQ ID NO: 282). In some embodiments, the deaminase is pmCDA1 (SEQ ID NO: 5738). In some embodiments, the deaminase is human APOBEC3G (SEQ ID NO: 275). In some embodiments, the deaminase is a human APOBEC3G variant of any one of (SEQ ID NOs: 5739-5741).

Some aspects of the disclosure are based on the recognition that certain configurations of a dCas9 domain, and a cytidine deaminase domain fused by a linker are useful for efficiently deaminating target cytidine residues. Other aspects of this disclosure relate to the recognition that a nucleobase editing fusion protein with an apolipoprotein B mRNA-editing complex 1 (APOBEC1) deaminase domain fused to the N-terminus of a nuclease inactive Cas9 (dCas9) via a linker comprising the amino acid sequence SGSET-PGTSESATPES (SEQ ID NO: 7) was capable of efficiently deaminating target nucleic acids in a double stranded DNA target molecule. In some embodiments, the fusion protein comprises a nuclease-inactive Cas9 (dCas9) domain and an apolipoprotein B mRNA-editing complex 1 (APOBEC1) deaminase domain, where the deaminase domain is fused to the N-terminus of the dCas9 domain via a linker comprising the amino acid sequence SGSETPGTSESATPES (SEQ ID NO: 7).

In some embodiments, the fusion protein comprises the amino acid residues 11-1629 of the amino acid sequence set forth in SEQ ID NO: 591. In some embodiments, the fusion protein comprises the amino acid sequence set forth in SEQ ID NO: 591. In some embodiments, the fusion protein comprises the amino acid sequence of any one of SEQ ID NOs: 5737, 5743, 5745, and 5746.

Some aspects of this disclosure provide strategies, systems, reagents, methods, and kits that are useful for the targeted editing of nucleic acids, including editing a single site within a subject's genome, e.g., a human's genome. In some embodiments, fusion proteins of Cas9 (e.g., dCas9, nuclease active Cas9, or Cas9 nickase) and deaminases or deaminase domains, are provided. In some embodiments, methods for targeted nucleic acid editing are provided. In some embodiments, reagents and kits for the generation of targeted nucleic acid editing proteins, e.g., fusion proteins of Cas9 and deaminases or deaminase domains, are provided.

Some aspects of this disclosure provide fusion proteins comprising a Cas9 protein as provided herein that is fused to a second protein (e.g., an enzymatic domain such as a cytidine deaminase domain), thus forming a fusion protein. In some embodiments, the second protein comprises an enzymatic domain, or a binding domain. In some embodiments, the enzymatic domain is a nuclease, a nickase, a recombinase, a deaminase, a methyltransferase, a methylase, an acetylase, an acetyltransferase, a transcriptional activator, or a transcriptional repressor domain. In some embodiments, the enzymatic domain is a nucleic acid editing domain. In some embodiments, the nucleic acid editing domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). It should be appreciated that the deaminase may be from any suitable organism (e.g., a human or a rat). In some embodiments, the deaminase is from a human, chimpanzee, gorilla, monkey, cow, dog, rat, or mouse. In some embodiments, the deaminase is rat APOBEC1 (SEQ ID NO: 284). In some embodiments, the deaminase is human APOBEC1 (SEQ ID NO: 282). In some embodiments, the deaminase is pmCDA1.

Some aspects of this disclosure provide fusion proteins comprising: (i) a nuclease-inactive Cas9 (dCas9) domain comprising the amino acid sequence of SEQ ID NO: 263; and (ii) an apolipoprotein B mRNA-editing complex 1 (APOBEC1) deaminase domain, wherein the deaminase domain is fused to the N-terminus of the dCas9 domain via a linker comprising the amino acid sequence of SGSET-PGTSESATPES (SEQ ID NO: 7). In some embodiments, the deaminase is rat APOBEC1 (SEQ ID NO: 284). In some embodiments, the deaminase is human APOBEC1 (SEQ ID NO: 282). In some embodiments, the fusion protein comprises the amino acid sequence of SEQ ID NO: 591. In some embodiments, the fusion protein comprises the amino acid sequence of SEQ ID NO: 5737. In some embodiments, the deaminase is pmCDA1 (SEQ ID NO: 5738). In some embodiments, the deaminase is human APOBEC3G (SEQ ID NO: 275). In some embodiments, the deaminase is a human APOBEC3G variant of any one of SEQ ID NOs: 5739-5741.

Some aspects of this disclosure provide fusion proteins comprising: (i) a Cas9 nickase domain and (ii) an apolipoprotein B mRNA-editing complex 1 (APOBEC1) deaminase domain, wherein the deaminase domain is fused to the N-terminus of the Cas9 nickase domain. In some embodiments, the Cas9 nickase domain comprises a D10X mutation of the amino acid sequence provided in SEQ ID NO: 10, or a corresponding mutation in any of the amino acid sequences provided in SEQ ID NOs: 11-260, wherein X is any amino acid except for D. In some embodiments, the amino acid sequence of the Cas9 nickase domain comprises a D10A mutation of the amino acid sequence provided in SEQ ID NO: 10, or a corresponding mutation in any of the amino acid sequences provided in SEQ ID NOs: 11-260. In some embodiments, the amino acid sequence of the Cas9 nickase domain comprises a histidine at amino acid position 840 of the amino acid sequence provided in SEQ ID NO: 10, or a corresponding amino acid position in any of the amino acid sequences provided in SEQ ID NOs: 11-260. In some embodiments, the amino acid sequence of the Cas9 nickase domain comprises the amino acid sequence as set forth in SEQ ID NO: 267. In some embodiments, the deaminase is rat APOBEC1 (SEQ ID NO: 284). In some embodiments, the deaminase is human APOBEC1 (SEQ ID NO: 282). In some embodiments, the deaminase is pmCDA1.

Some aspects of this disclosure provide fusion proteins comprising: (i) a Cas9 nickase domain and (ii) an apolipoprotein B mRNA-editing complex 1 (APOBEC1) deaminase domain, wherein the deaminase domain is fused to the N-terminus of the Cas9 nickase domain. In some embodiments, the Cas9 nickase domain comprises a D10X mutation of the amino acid sequence provided in SEQ ID NO: 10, or a corresponding mutation in any of the amino acid sequences provided in SEQ ID NOs: 11-260, wherein X is any amino acid except for D. In some embodiments, the amino acid sequence of the Cas9 nickase domain comprises a D10A mutation of the amino acid sequence provided in SEQ ID NO: 10, or a corresponding mutation in any of the amino acid sequences provided in SEQ ID NOs: 11-260. In some embodiments, the amino acid sequence of the Cas9 nickase domain comprises a histidine at amino acid position 840 of the amino acid sequence provided in SEQ ID NO: 10, or a corresponding amino acid position in any of the amino acid sequences provided in SEQ ID NOs: 11-260. In some embodiments, the amino acid sequence of the Cas9 nickase domain comprises the amino acid sequence as set forth in SEQ ID NO: 267. In some embodiments, the deaminase is rat APOBEC1 (SEQ ID NO: 284). In some embodiments, the deaminase is human APOBEC1 (SEQ ID NO: 282). In some embodiments, the deaminase is pmCDA1.

Other aspects of this disclosure relate to the recognition that fusion proteins comprising a deaminase domain, a dCas9 domain and a uracil glycosylase inhibitor (UGI) domain demonstrate improved efficiency for deaminating target nucleotides in a nucleic acid molecule. Without wishing to be bound by any particular theory, cellular DNA-repair response to the presence of U:G heteroduplex DNA may be responsible for a decrease in nucleobase editing efficiency in cells. Uracil DNA glycosylase (UDG) catalyzes removal of U from DNA in cells, which may initiate base excision repair, with reversion of the U:G pair to a C:G pair as the most common outcome. As demonstrated herein, Uracil DNA Glycosylase Inhibitor (UGI) may inhibit human UDG activity. Without wishing to be bound by any particular theory, base excision repair may be inhibited by molecules that bind the single strand, block the edited base, inhibit UGI, inhibit base excision repair, protect the edited base, and/or promote "fixing" of the non-edited strand, etc. Thus, this disclosure contemplates fusion proteins comprising a dCas9-cytidine deaminase domain that is fused to a UGI domain.

In some embodiments, the fusion protein comprises a nuclease-inactive Cas9 (dCas9) domain; a nucleic acid editing domain; and a uracil glycosylase inhibitor (UGI) domain. In some embodiments, the dCas9 domain comprises a D10X mutation of the amino acid sequence provided in SEQ ID NO: 10, or a corresponding mutation in any of the amino acid sequences provided in SEQ ID NOs: 11-260, wherein X is any amino acid except for D. In some embodiments, the amino acid sequence of the dCas9 domain comprises a D10A mutation of the amino acid sequence provided in SEQ ID NO: 10, or a corresponding mutation in any of the amino acid sequences provided in SEQ ID NOs: 11-260. In some embodiments, the amino acid sequence of the dCas9 domain comprises an H840X mutation of the amino acid sequence provided in SEQ ID NO: 10, or a corresponding mutation in any of the amino acid sequences provided in SEQ ID NOs: 11-260, wherein X is any amino acid except for H. In some embodiments, the amino acid sequence of the dCas9 domain comprises an H840A mutation of the amino acid sequence provided in SEQ ID NO: 10, or a corresponding mutation in any of the amino acid sequences provided in SEQ ID NOs: 11-260. In some embodiments, the dCas9 domain comprises the amino acid sequence as set forth in SEQ ID NO: 263.

Further aspects of this disclosure relate to the recognition that fusion proteins using a Cas9 nickase as the Cas9 domain demonstrate improved efficiency for editing nucleic acids. For example, aspects of this disclosure relate to the recognition that fusion proteins comprising a Cas9 nickase, a deaminase domain and a UGI domain demonstrate improved efficiency for editing nucleic acids. For example, the improved efficiency for editing nucleotides is described below in the Examples section.

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations.

In some embodiments, a fusion protein comprises a Cas9 nickase domain, a nucleic acid editing domain; and a uracil glycosylase inhibitor (UGI) domain. In some embodiments, the amino acid sequence of the Cas9 nickase domain comprises a D10X mutation of the amino acid sequence provided in SEQ ID NO: 10, or a corresponding mutation in any of the amino acid sequences provided in SEQ ID NOs: 11-260, wherein X is any amino acid except for D. In some embodiments, the amino acid sequence of the Cas9 nickase domain comprises a D10A mutation of the amino acid sequence provided in SEQ ID NO: 10, or a corresponding mutation in any of the amino acid sequences provided in SEQ ID NOs: 11-260. In some embodiments, the amino acid sequence of the Cas9 nickase domain comprises a histidine at amino acid position 840 of the amino acid sequence provided in SEQ ID NO: 10, or a corresponding amino acid position in any of the amino acid sequences provided in SEQ ID NOs: 11-260. In some embodiments, the amino acid sequence of the Cas9 nickase domain comprises the amino acid sequence as set forth in SEQ ID NO: 267.

In some embodiments, the deaminase domain of the fusion protein is fused to the N-terminus of the dCas9 domain or the Cas9 nickase. In some embodiments, the UGI domain is fused to the C-terminus of the dCas9 domain or the Cas9 nickase. In some embodiments, the dCas9 domain or the Cas9 nickase and the nucleic acid editing domain are fused via a linker. In some embodiments, the dCas9 domain or the Cas9 nickase and the UGI domain are fused via a linker.

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included funtionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker comprises the amino acid sequence $(GGGGS)_n$ (SEQ ID NO: 5), $(G)_n$, $(EAAAK)_n$ (SEQ ID NO: 6), $(GGS)_n$, $(SGGS)_n$ (SEQ ID NO: 4288), SGSETPGTSESATPES (SEQ ID NO: 7), $(XP)_n$, or any combination thereof, wherein n is independently an integer between 1 and 30, and wherein X is any amino acid. In some embodiments, the linker comprises the amino acid sequence $(GGS)_n$, wherein n is 1, 3, or 7. In some embodiments, the linker comprises the amino acid sequence SGSETPGTSESATPES (SEQ ID NO: 7).

In some embodiments, the fusion protein comprises the structure [nucleic acid editing domain]-[optional linker sequence]-[dCas9 or Cas9 nickase]-[optional linker sequence]-[UGI]. In some embodiments, the fusion protein comprises the structure [nucleic acid editing domain]-[optional linker sequence]-[UGI]-[optional linker sequence]-[dCas9 or Cas9 nickase]; [UGI]-[optional linker sequence]-[nucleic acid editing domain]-[optional linker sequence]-[dCas9 or Cas9 nickase]; [UGI]-[optional linker sequence]-[dCas9 or Cas9 nickase]-[optional linker sequence]-[nucleic acid editing domain]; [dCas9 or Cas9 nickase]-[optional linker sequence]-[UGI]-[optional linker sequence]-[nucleic acid editing domain]; or [dCas9 or Cas9 nickase]-[optional linker sequence]-[nucleic acid editing domain]-[optional linker sequence]-[UGI].

In some embodiments, the nucleic acid editing domain comprises a deaminase. In some embodiments, the nucleic acid editing domain comprises a deaminase. In some embodiments, the deaminase is a cytidine deaminase. In some embodiments, the deaminase is an apolipoprotein B mRNA-editing complex (APOBEC) family deaminase. In some embodiments, the deaminase is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, or an APOBEC4 deaminase. In some embodiments, the deaminase is an activation-induced deaminase (AID). In some embodiments, the deaminase is a Lamprey CDA1 (pmCDA1) deaminase.

In some embodiments, the deaminase is from a human, chimpanzee, gorilla, monkey, cow, dog, rat, or mouse. In some embodiments, the deaminase is from a human. In some embodiments the deaminase is from a rat. In some embodiments, the deaminase is a rat APOBEC1 deaminase comprising the amino acid sequence set forth in (SEQ ID NO: 284). In some embodiments, the deaminase is a human APOBEC1 deaminase comprising the amino acid sequence set forth in (SEQ ID NO: 282). In some embodiments, the deaminase is pmCDA1 (SEQ ID NO: 5738). In some embodiments, the deaminase is human APOBEC3G (SEQ ID NO: 275). In some embodiments, the deaminase is a human APOBEC3G variant of any one of (SEQ ID NOs: 5739-5741). In some embodiments, the deaminase is at least 80%, at least 85%, at least 90%, at least 92%, at least 95%, at least 96%, at least 97%, at least 98%, at least 99%, or at least 99.5% identical to any one of the amino acid sequences set forth in SEQ ID NOs: 266-284 or 5725-5741.

In some embodiments, the UGI domain comprises an amino acid sequence that is at least 80%, at least 85%, at least 90%, at least 92%, at least 95%, at least 96%, at least 97%, at least 98%, at least 99%, or at least 99.5% identical to SEQ ID NO: 600. In some embodiments, the UGI domain comprises the amino acid sequence as set forth in SEQ ID NO: 600.

Some aspects of this disclosure provide complexes comprising a Cas9 protein or a Cas9 fusion protein as provided herein, and a guide RNA bound to the Cas9 protein or the Cas9 fusion protein.

Some aspects of this disclosure provide methods of using the Cas9 proteins, fusion proteins, or complexes provided herein. For example, some aspects of this disclosure provide methods comprising contacting a DNA molecule (a) with a Cas9 protein or a fusion protein as provided herein and with a guide RNA, wherein the guide RNA is about 15-100 nucleotides long and comprises a sequence of at least 10 contiguous nucleotides that is complementary to a target sequence; or (b) with a Cas9 protein, a Cas9 fusion protein, or a Cas9 protein or fusion protein complex with a gRNA as provided herein.

Some aspects of this disclosure provide kits comprising a nucleic acid construct, comprising (a) a nucleotide sequence encoding a Cas9 protein or a Cas9 fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a Cas9 protein of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising a Cas9 protein, a fusion protein, a nucleic acid molecule, and/or a vector as provided herein.

The description of exemplary embodiments of the reporter systems above is provided for illustration purposes only and not meant to be limiting. Additional reporter systems, e.g., variations of the exemplary systems described in detail above, are also embraced by this disclosure.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 11A: Nucleobase editing strategy. DNA with a target C (red) at a locus specified by a guide RNA (green) is bound by dCas9 (blue), which mediates the local denaturation of the DNA substrate. Cytidine deamination by a tethered APOBEC1 enzyme (orange) converts the target C to U. The resulting G:U heteroduplex can be permanently converted to an A:T base pair following DNA replication or repair. If the U is in the template DNA strand, it will also result in an RNA transcript containing a G to A mutation following transcription. FIG. 11B: Deamination assay showing an activity window of approximately five nucleotides. Following incubation of NBE1-sgRNA complexes with dsDNA substrates at 37° C. for 2 h, the 5' fluorophore-labeled DNA was isolated and incubated with USER enzyme (uracil DNA glycosylase and endonuclease VIII) at 37° C. for 1 h to induce DNA cleavage at the site of any uracils. The resulting DNA was resolved on a denaturing polyacrylamide gel, and any fluorophore-linked strands were visualized. Each lane is labeled according to the position of the target C within the protospacer, or with "-" if no target C is present, counting the base distal from the PAM as position 1. FIG. 11C: Deaminase assay showing the sequence specificity and sgRNA-dependence of NBE1. The DNA substrate with a target C at position 7 was incubated with NBE1 as in FIG. 11B with either the correct sgRNA, a mismatched sgRNA, or no sgRNA. No C to U editing is observed with the mismatched sgRNA or with no sgRNA. The positive control sample contains a DNA sequence with a U synthetically incorporated at position 7.

FIG. 12A: Effect of changing the sequence surrounding the target C on editing efficiency in vitro. The deamination yield of 80% of targeted strands (40% of total sequencing reads from both strands) for $C_7$ in the protospacer sequence 5'-TTATTTCGTGGATTTATTTA-3'(SEQ ID NO: 264) was defined as 1.0, and the relative deamination efficiencies of substrates containing all possible single-base mutations at positions 1-6 and 8-13 are shown. Values and error bars reflect the mean and standard deviation of two or more independent biological replicates performed on different days. FIG. 12B: Positional effect of each NC motif on editing efficiency in vitro. Each NC target motif was varied from positions 1 to 8 within the protospacer as indicated in the sequences shown on the right (the PAM shown in red, the protospacer plus one base 5' to the protospacer are also shown). The percentage of total sequence reads containing T at each of the numbered target C positions following incubation with NBE1 is shown in the graph. Note that the maximum possible deamination yield in vitro is 50% of total sequencing reads (100% of targeted strands). Values and error bars reflect the mean and standard deviation of two or three independent biological replicates performed on different days. FIG. 12B depicts SEQ ID NOs: 5750 through 5757 from top to bottom, respectively.

FIG. 13A: Protospacer (black) and PAM (red) sequences of the six mammalian cell genomic loci targeted by nucleobase editors. Target Cs are indicated with subscripted numbers corresponding to their positions within the protospacer. FIG. 13A depicts SEQ ID NOs: 293 through 298 from top to bottom, respectively. FIG. 13B: HEK293T cells were transfected with plasmids expressing NBE1, NBE2, or NBE3 and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for NBE1, NBE2, and NBE3 at all six genomic loci, and for wt Cas9 with a donor HDR template at three of the six sites (EMX1, HEK293 site 3, and HEK293 site 4). Values and error bars reflect the mean and standard deviation of three independent biological replicates performed on different days. FIG. 13C: Frequency of indel formation, calculated as described in the Methods, is shown following treatment of HEK293T cells with NBE2 and NBE3 for all six genomic loci, or with wt Cas9 and a single-stranded DNA template for HDR at three of the six sites (EMX1, HEK293 site 3, and HEK293 site 4). Values reflect the mean of at least three independent biological replicates performed on different days.

Figures 14A, 14B, 14C:
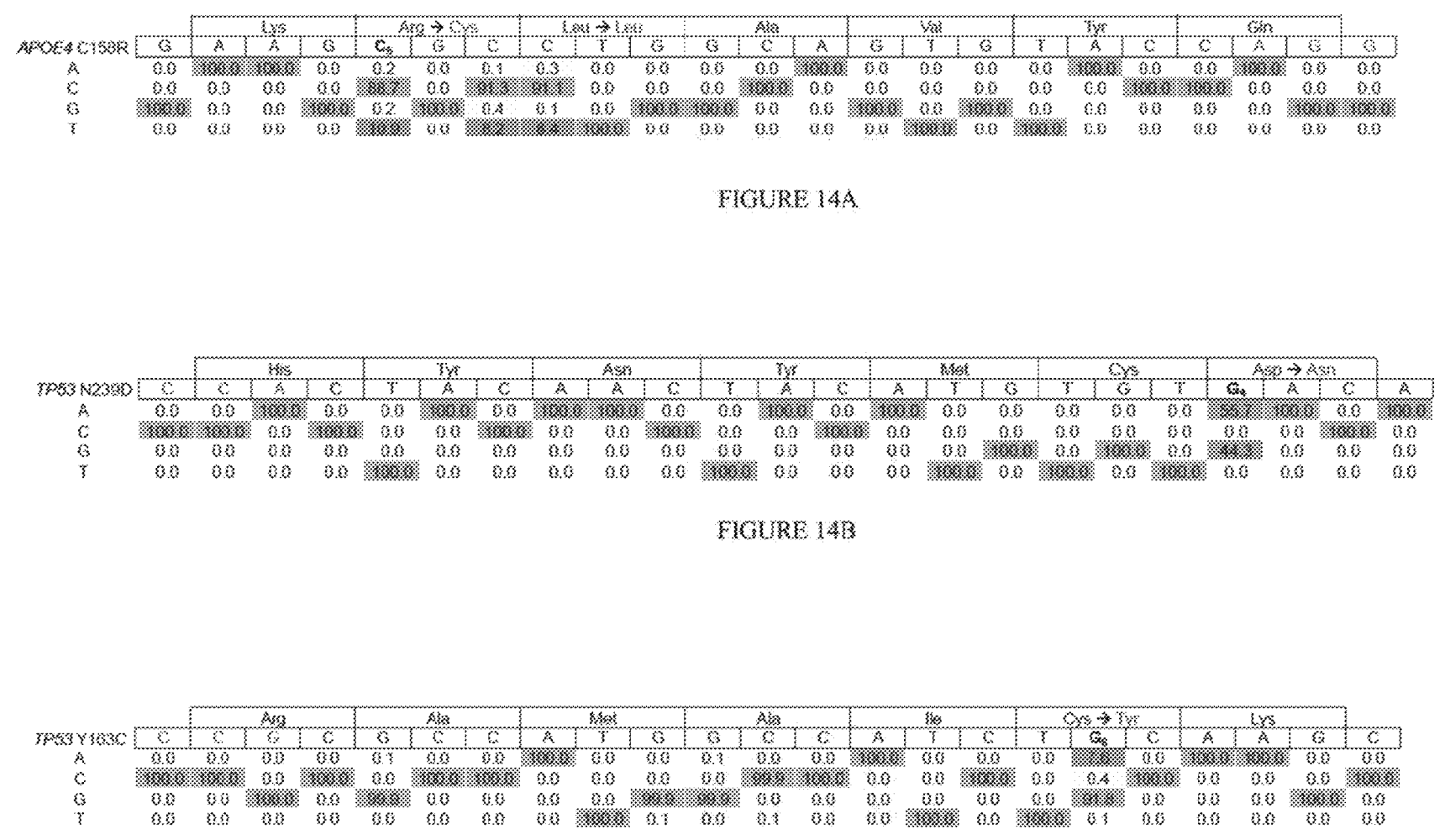

FIGS. 14A to 14C show NBE2- and NBE3-mediated correction of three disease-relevant mutations in mammalian cells. For each site, the sequence of the protospacer is indicated to the right of the name of the mutation, with the PAM highlighted in green and the base responsible for the mutation indicated in bold with a subscripted number corresponding to its position within the protospacer. The amino acid sequence above each disease-associated allele is shown, together with the corrected amino acid sequence following nucleobase editing in red. Underneath each sequence are the percentages of total sequencing reads with the corresponding base. Cells were nucleofected with plasmids encoding NBE2 or NBE3 and an appropriate sgRNA. Two days after nucleofection, genomic DNA was extracted and analyzed by HTS to assess pathogenic mutation correction. FIG. 14A: The Alzheimer's disease-associated APOE4 allele is converted to APOE3' in mouse astrocytes by NBE3 in 11% of total reads (44% of nucleofected astrocytes). Two nearby Cs are also converted to Ts, but with no change to the predicted sequence of the resulting protein (SEQ ID NO: 299). The DNA sequence in FIG. 14A corresponds to SEQ ID NO: 5747. FIG. 14B The cancer-associated p53 N239D mutation is corrected by NBE2 in 11% of treated human lymphoma cells (12% of nucleofected cells) that are heterozygous for the mutation (SEQ ID NO: 300). The DNA sequence in FIG. 14B corresponds to SEQ ID NO: 5748. FIG. 14C The p53 Y163C mutation is corrected by NBE3 in 7.6% of nucleofected human breast cancer cells (SEQ ID NO: 301). The DNA sequence FIG. 14C corresponds to SEQ ID NO: 5749.

FIGS. 16A to 16B show NBE1 is capable of correcting disease-relevant mutations in vitro. FIG. 16A: Protospacer and PAM sequences (red) of seven disease-relevant mutations. The disease-associated target C in each case is indicated with a subscripted number reflecting its position within the protospacer. For all mutations except both APOE4 SNPs, the target C resides in the template (non-coding) strand. FIG. 16A depicts SEQ ID NOs: 5760, 5747, and 5761 through 5765 from top to bottom, respectively. FIG. 16B: Deaminase assay showing each dsDNA oligonucleotide before (−) and after (+) incubation with NBE1, DNA isolation, and incubation with USER enzymes to cleave DNA at positions containing U. Positive control lanes from incubation of synthetic oligonucleotides containing U at various positions within the protospacer with USER enzymes are shown with the corresponding number indicating the position of the U.

FIG. 17 shows processivity of NBE1. The protospacer and PAM (red) of a 60-mer DNA oligonucleotide containing eight consecutive Cs is shown at the top. The oligonucleotide (125 nM) was incubated with NBE1 (2 µM) for 2 h at 37° C. The DNA was isolated and analyzed by high-throughput sequencing. Shown are the percent of total reads for the most frequent nine sequences observed. The vast majority of edited strands (>93%) have more than one C converted to T. This figure depicts SEQ ID NO: 5766.

FIGS. 18A to 18H show the effect of fusing UGI to NBE1 to generate NBE2. FIG. 18A: Protospacer and PAM (red) sequences of the six mammalian cell genomic loci targeted with nucleobase editors. Editable Cs are indicated with labels corresponding to their positions within the protospacer. FIG. 18A depicts SEQ ID NOs: 293 through 298 from top to bottom, respectively. FIGS. 18B to 18G: HEK293T cells were transfected with plasmids expressing NBE1, NBE2, or NBE1 and UGI, and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for NBE1, NBE1 and UGI, and. NBE2 at all six genomic loci. FIG. 18H: C to T mutation rates at 510 Cs surrounding the protospacers of interest for NBE1, NBE1 plus UGI on a separate plasmid, NBE2, and untreated cells are shown. The data show the results of 3,000,000 DNA sequencing reads from $1.5 \times 10^6$ cells. Values reflect the mean of at least two biological experiments conducted on different days.

Figure 22:
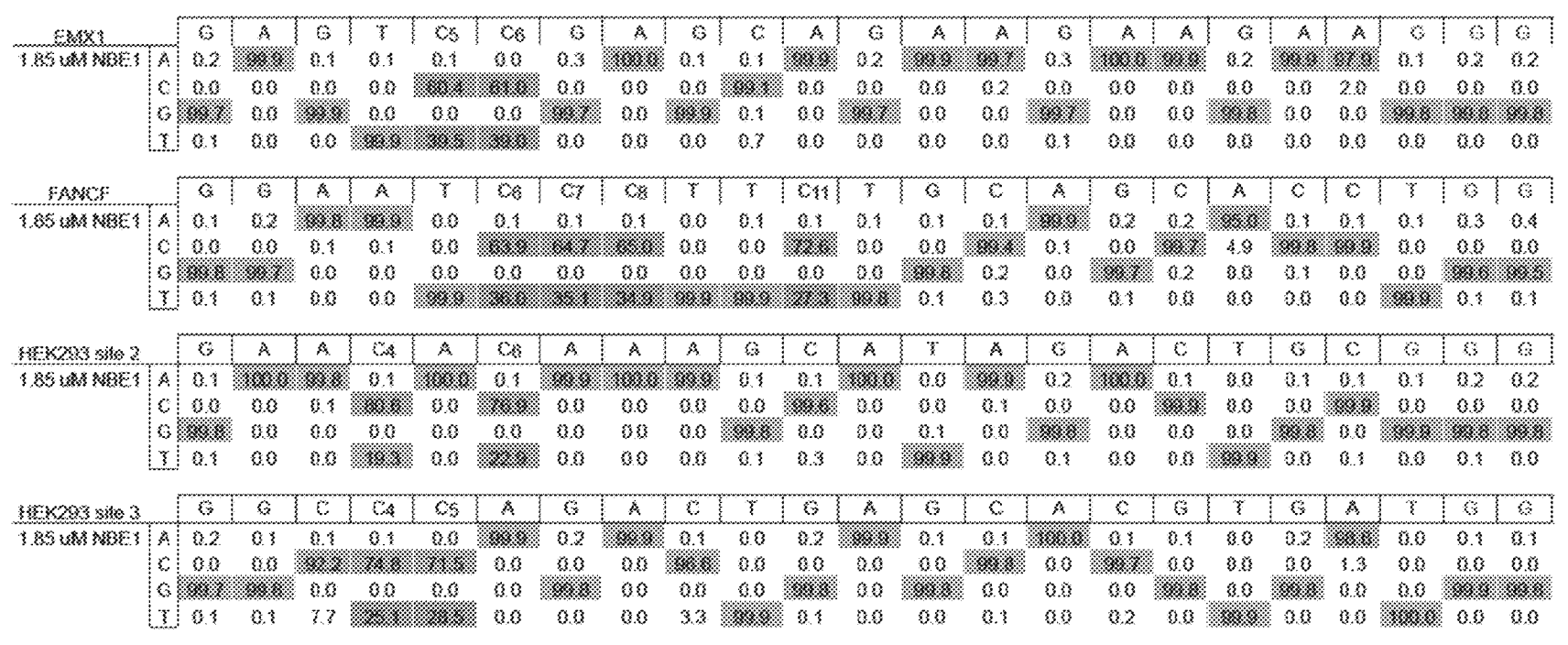
Figure 22:
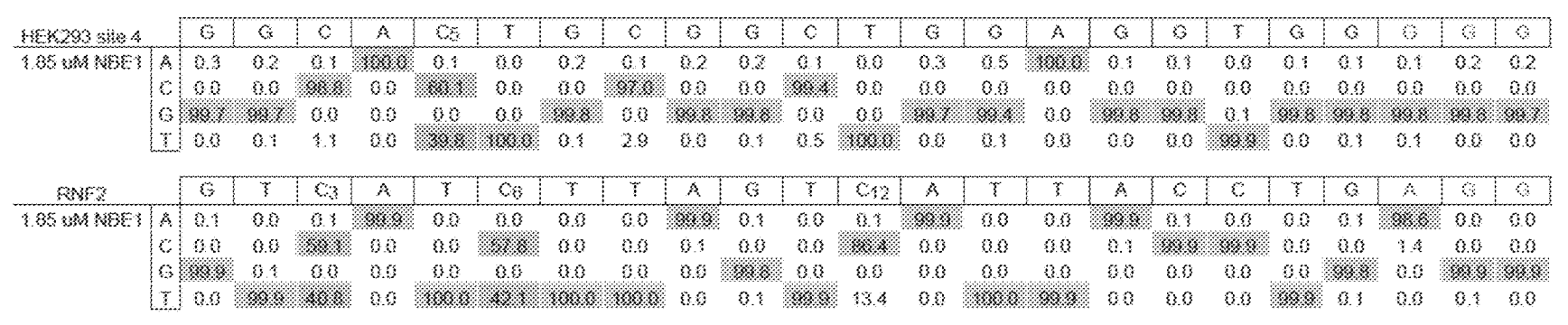

FIG. 22 shows in vitro identification of editable Cs in six genomic loci. Synthetic 80-mers with sequences matching six different genomic sites were incubated with NBE1 then analyzed for nucleobase editing via FITS. For each site, the sequence of the protospacer is indicated to the right of the name of the site, with the PAM highlighted in red. Underneath each sequence are the percentages of total DNA sequencing reads with the corresponding base. A target C was considered as "editable" if the in vitro conversion efficiency is >10%. Note that maximum yields are 50% of total DNA sequencing reads since the non-targeted strand is not a substrate for nucleobase editing. This figure depicts SEQ ID NOs: 293 through 298 from top to bottom, respectively.

Figure 24:
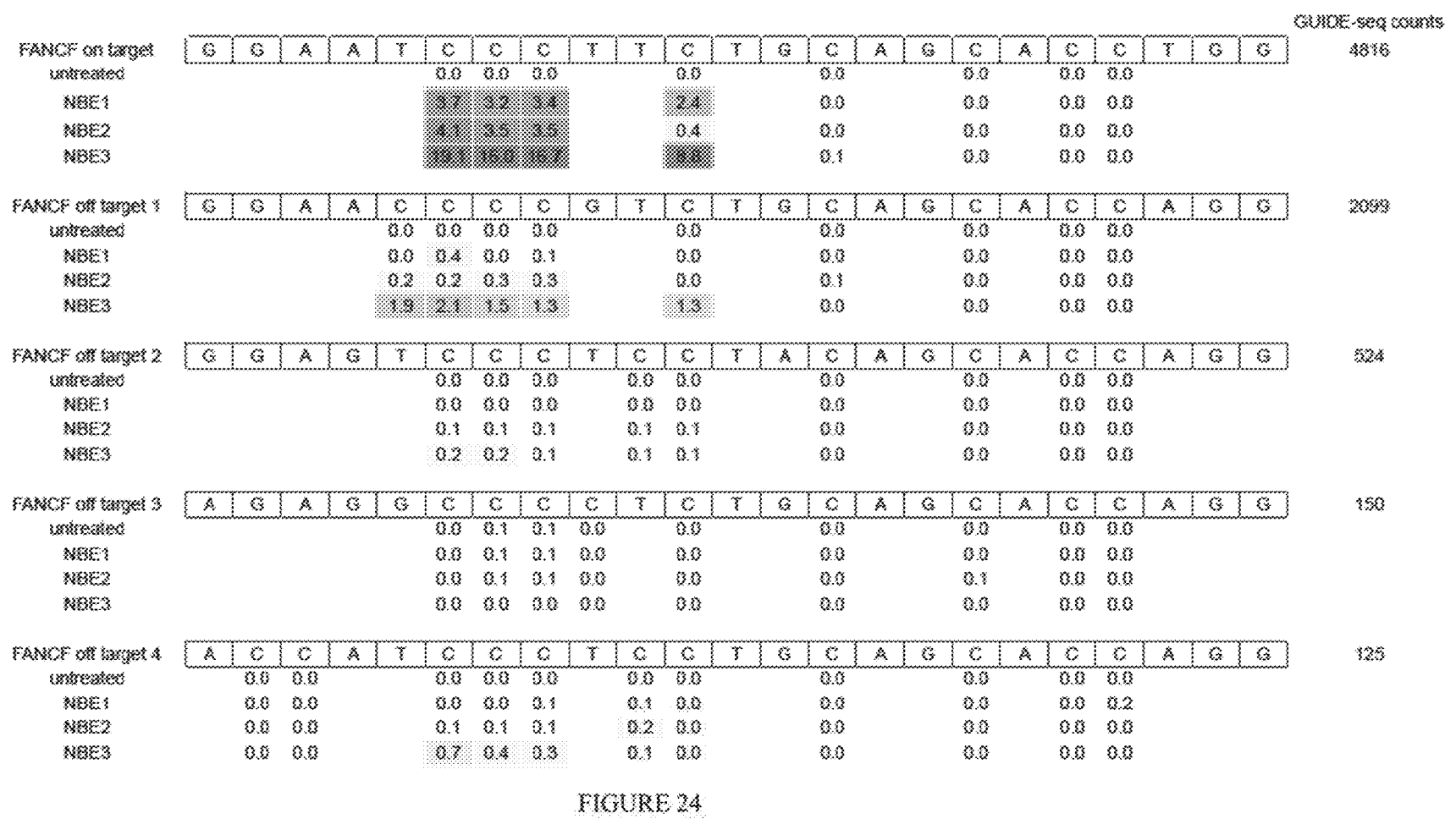
Figure 24:
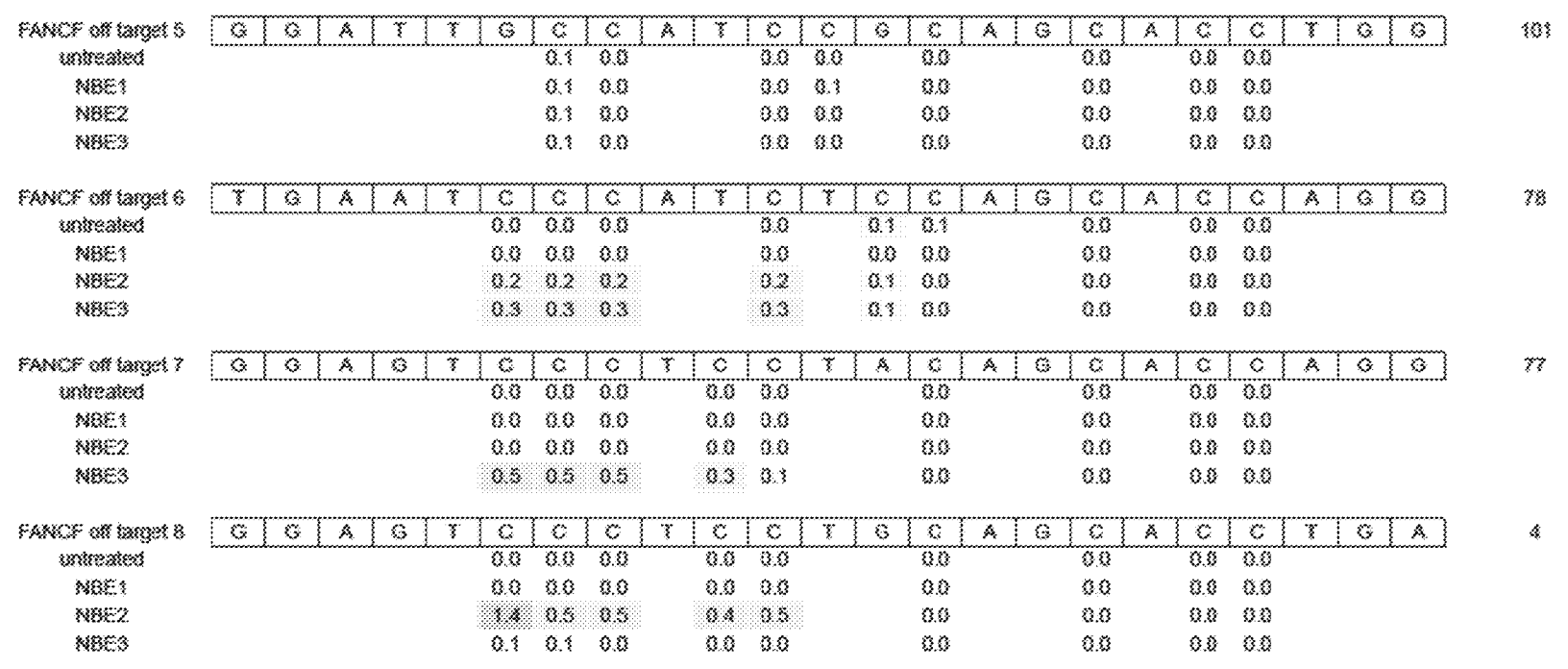

FIG. 24 shows activities of NBE1, NBE2, and NBE3 at FANCF off-targets. HEK293T cells were transfected with plasmids expressing NBE1, NBE2, or NBE3 and a sgRNA matching the FANCF sequence using Lipofectamine 2000. Three days after transfection, genomic DNA was extracted, amplified by PCR, and analyzed by high-throughput DNA sequencing at the on-target loci, plus all of the known Cas9 off-target loci for the FANCF sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 294 and 5776 through 5781, 5777, and 5782 from top to bottom, respectively.

Figure 26:
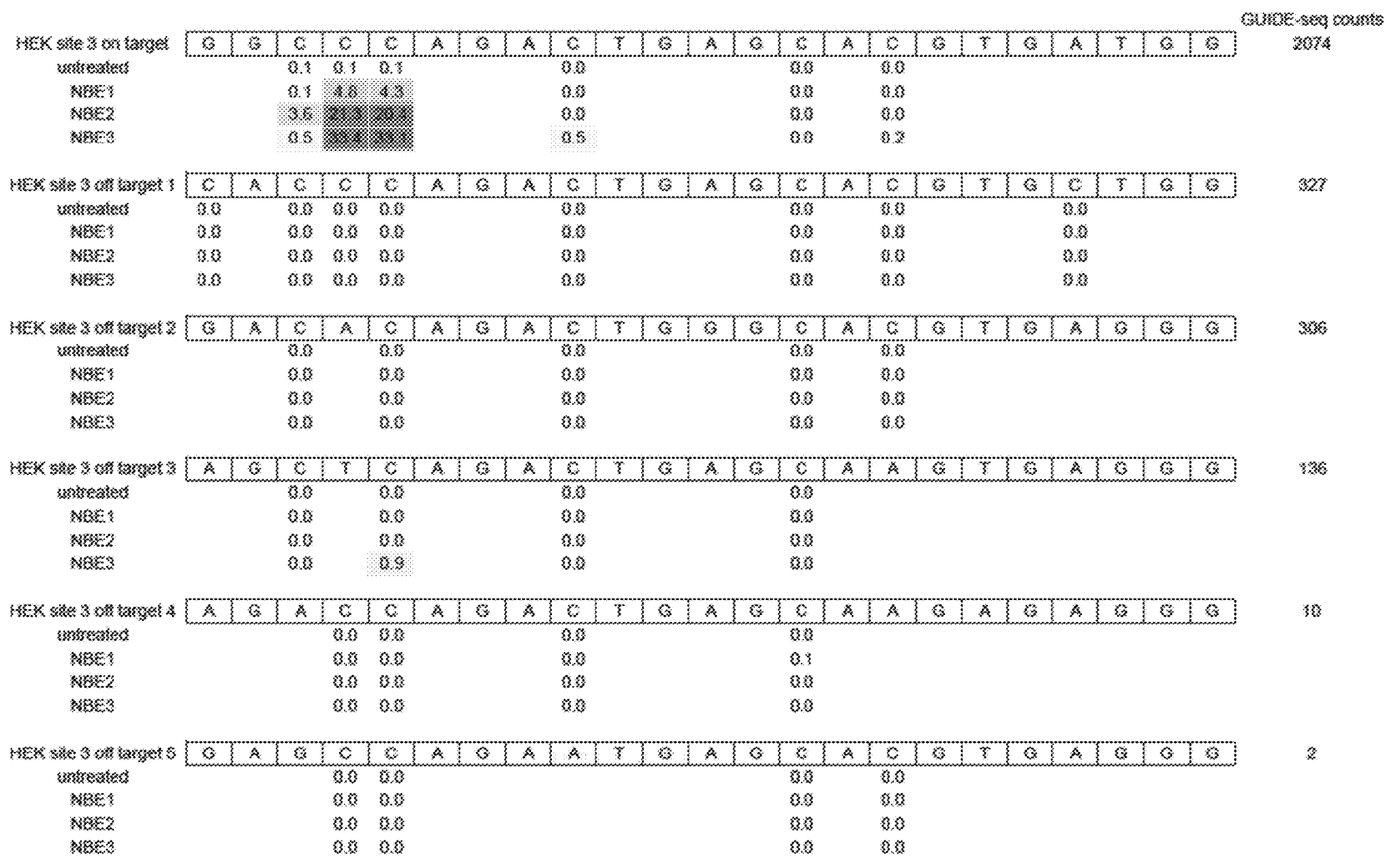

FIG. 26 shows activities of NBE1, NBE2, and NBE3 at HEK293 site 3 off-targets. HEK293T cells were transfected with plasmids expressing NBE1, NBE2, or NBE3 and a sgRNA matching the HEK293 site 3 sequence using Lipofectamine 2000. Three days after transfection, genomic DNA was extracted, amplified by PCR, and analyzed by high-throughput DNA sequencing at the on-target loci, plus all of the known Cas9 off-target loci for the HEK293 site 3 sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 296 and 659 through 663 from top to bottom, respectively.

Figure 27:
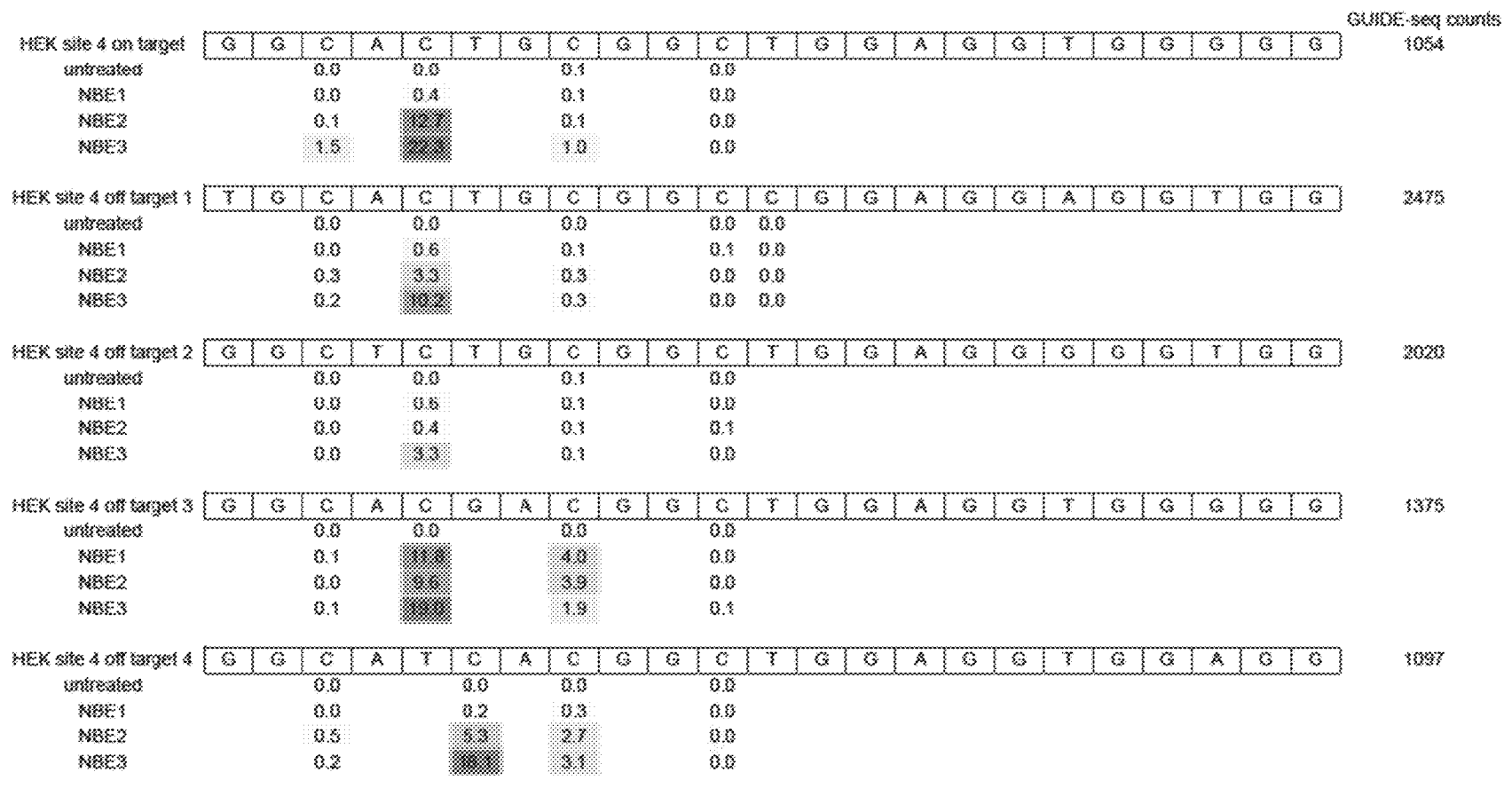
Figure 27:
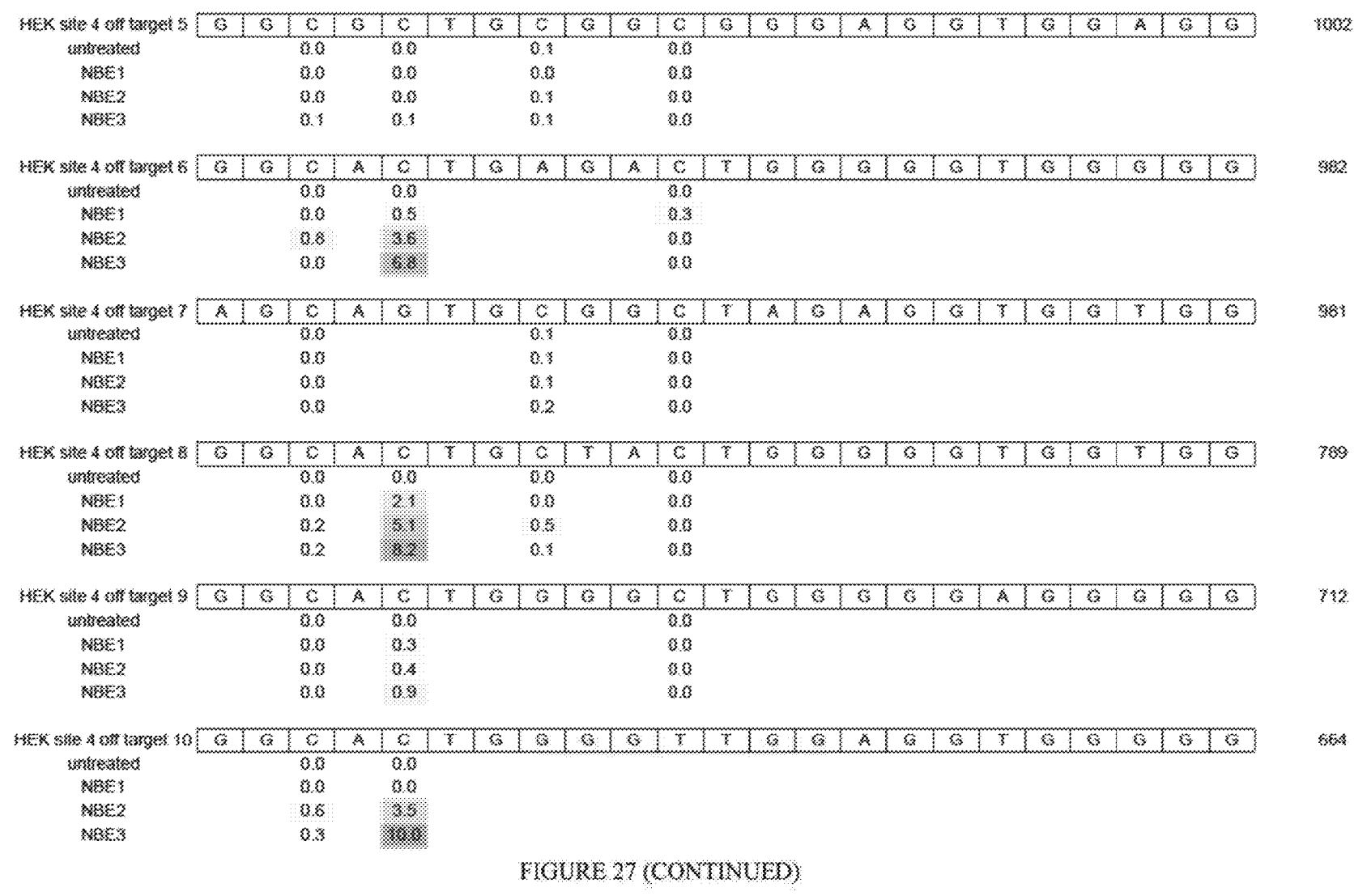

FIG. 27 shows activities of NBE1, NBE2, and NBE3 at HEK293 site 4 off-targets. HEK293T cells were transfected with plasmids expressing NBE1, NBE2, or NBE3 and a sgRNA matching the HEK293 site 4 sequence using Lipofectamine 2000. Three days after transfection, genomic DNA was extracted, amplified by PCR, and analyzed by high-throughput DNA sequencing at the on-target loci, plus the top ten known Cas9 off-target loci for the HEK293 site 4 sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 297 and 664 through 673 from top to bottom, respectively.

FIG. 29A shows possible base editing outcomes in mammalian cells. Initial editing resulted in a U:G mismatch. Recognition and excision of the U by uracil DNA glycosylase (UDG) initiated base excision repair (BER), which lead to reversion to the C:G starting state. BER was impeded by BE2 and BE3, which inhibited UDG. The U:G mismatch was also processed by mismatch repair (MMR), which preferentially repaired the nicked strand of a mismatch. BE3 nicked the non-edited strand containing the G, favoring resolution of the U:G mismatch to the desired U:A or T:A outcome. FIG. 29B shows HEK293T cells treated as described in the Materials and Methods in the Examples below. The percentage of total DNA sequencing read with Ts at the target positions indicated show treatment with BE1, BE2, or BE3, or for treatment with wt Cas9 with a donor HDR template. FIG. 29C shows frequency of indel formation following the treatment in FIG. 29B. Values are listed in FIG. 34. For FIGS. 29B and 29C, values and error bars reflect the mean and s.d. of three independent biological replicates performed on different days.

FIGS. 30A to 30B show BE3-mediated correction of two disease-relevant mutations in mammalian cells. The sequence of the protospacer is shown to the right of the mutation, with the PAM in blue and the target base in red with a subscripted number indicating its position within the protospacer. Underneath each sequence are the percentages of total sequencing reads with the corresponding base. Cells were treated as described in the Materials and Methods. FIG. 30A shows the Alzheimer's disease-associated APOE4 allele converted to APOE3r in mouse astrocytes by BE3 in 74.9% of total reads. Two nearby Cs were also converted to Ts, but with no change to the predicted sequence of the resulting protein. Identical treatment of these cells with wt Cas9 and donor ssDNA results in only 0.3% correction, with 26.1% indel formation. FIG. 30B shows the cancer associated p53 Y163C mutation corrected by BE3 in 7.6% of nucleofected human breast cancer cells with 0.7% indel formation. Identical treatment of these cells with wt Cas9 and donor ssDNA results in no mutation correction with 6.1% indel formation. The amino acid sequences in FIG. 30A correspond to SEQ ID NOs: 675, 299, and 299 from top to bottom, respectively. The three DNA sequences in FIG. 30A correspond to SEQ ID NO: 5747. The amino acid sequences in FIG. 30B correspond to SEQ ID NOs: 678, 301, and 301 from top to bottom, respectively. The three DNA sequences in FIG. 30B correspond to SEQ ID NO: 5749.

Figure 32:
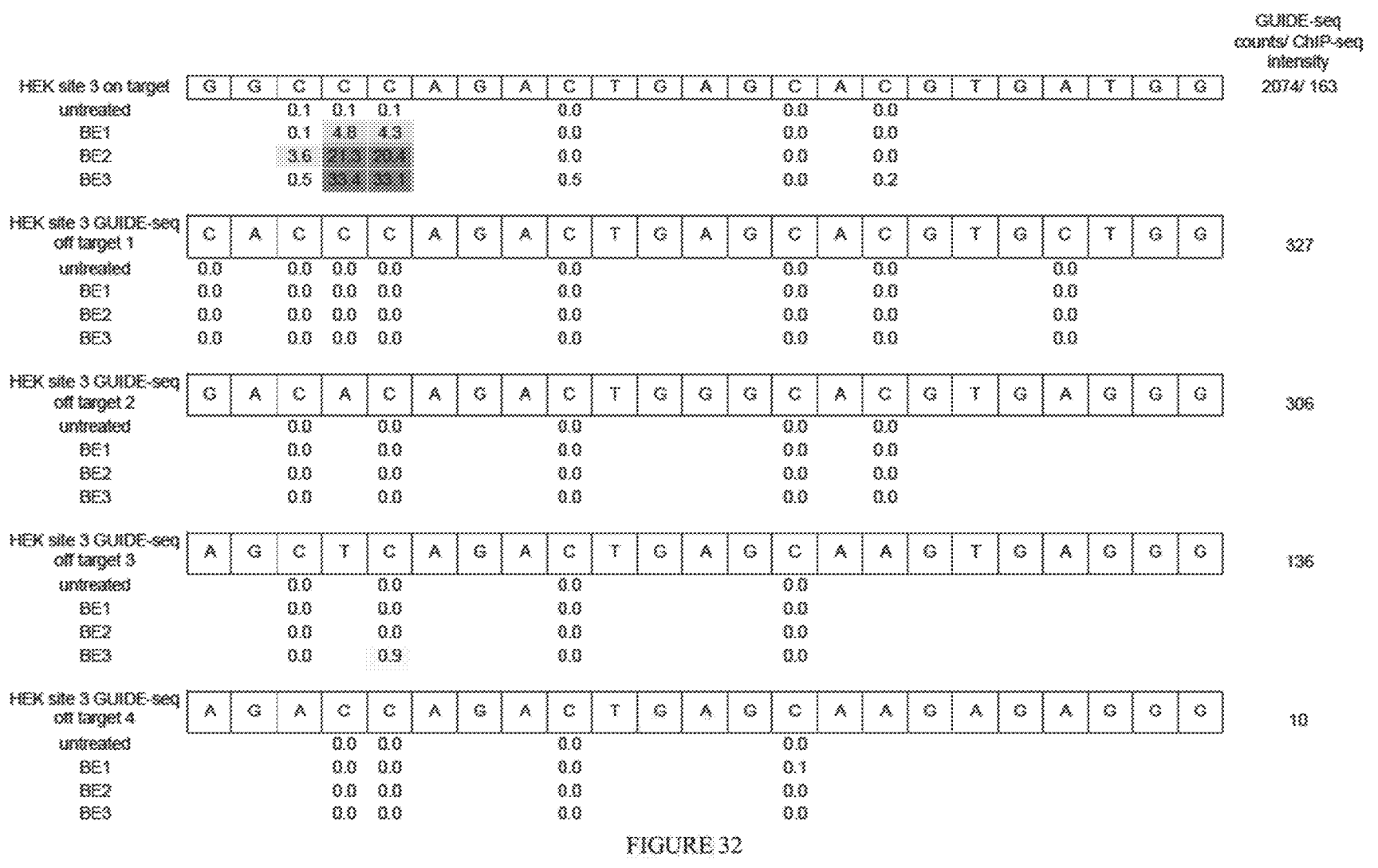
Figure 32:
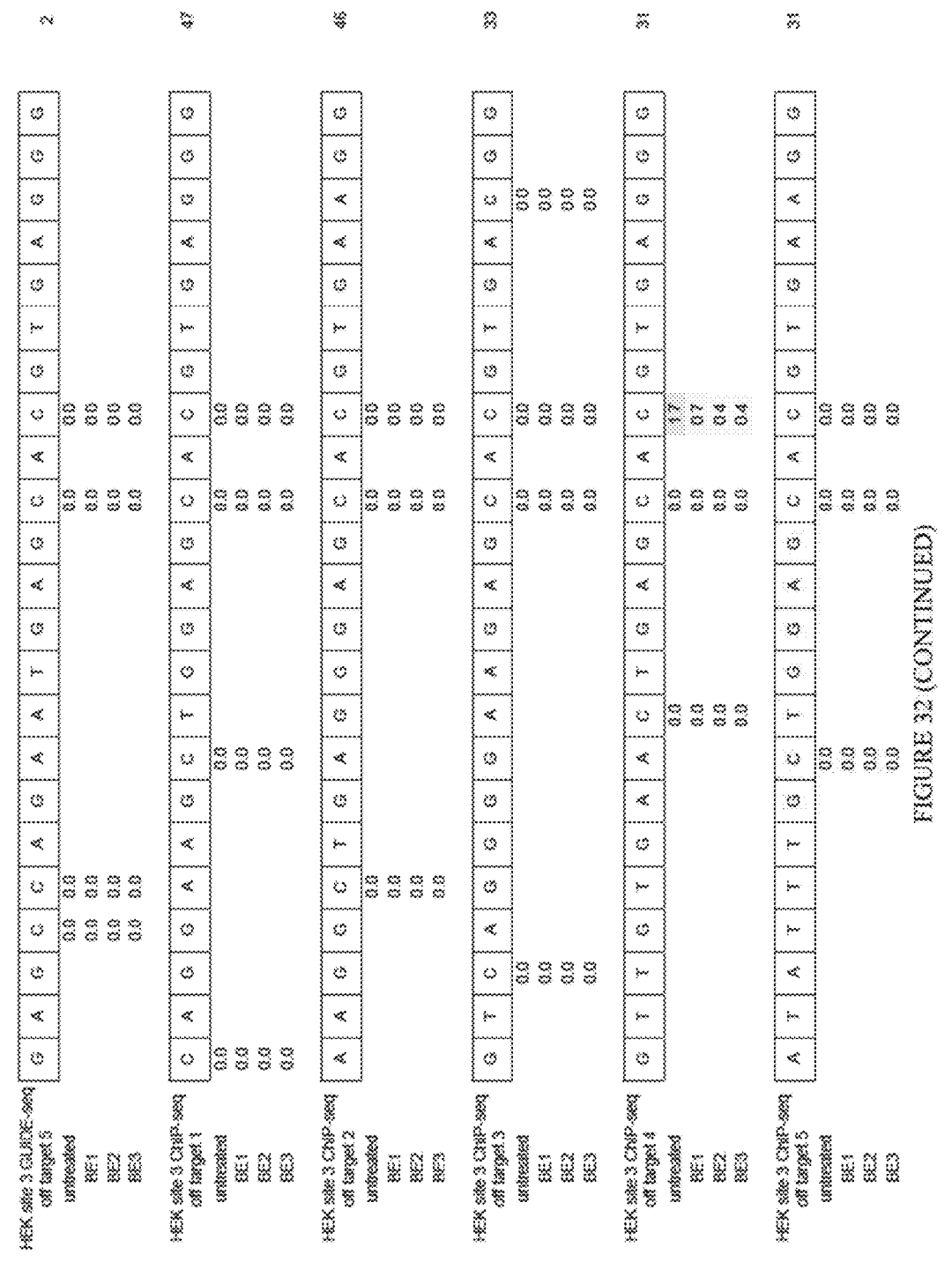

FIG. 32 shows activities of BE1, BE2, a signal nd BE3 at HEK293 site 3 off-targets. HEK293T cells were transfected with plasmids expressing BE1, BE2, or BE3 and a sgRNA matching the HEK293 site 3 sequence using Lipofectamine 2000. Three days after transfection, genomic DNA was extracted, amplified by PCR, and analyzed by high-throughput DNA sequencing at the on-target loci, plus all of the known Cas9 off-target loci and the top five known dCas9 off-target loci for the HEK293 site 3 sgRNA, as previously determined by Joung and coworkers using the GUIDE-seq method[54], and using chromatin immunoprecipitation high-throughput sequencing (ChIP-seq) experiments[61]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq signal intensity reported for each sequence. This figure depicts SEQ ID NOs: 296, 659 through 663 and 695 through 699 from top to bottom, respectively.

FIG. 34 shows mutation rates of non-protospacer bases following BE3-mediated correction of the Alzheimer's disease-associated APOE4 allele to APOE3r in mouse astrocytes. The DNA sequence of the 50 bases on either side of the protospacer from FIG. 30A and FIG. 34B is shown with each base's position relative to the protospacer. The side of the protospacer distal to the PAM is designated with positive numbers, while the side that includes the PAM is designated with negative numbers, with the PAM shown in blue. Underneath each sequence are the percentages of total DNA sequencing reads with the corresponding base for untreated cells, for cells treated with BE3 and an sgRNA targeting the APOE4 C158R mutation, or for cells treated with BE3 and an sgRNA targeting the VEGFA locus. Neither BE3-treated sample resulted in mutation rates above those of untreated controls. This figure depicts SEQ ID NOs: 713 to 716 from top to bottom, respectively.

FIG. 35 shows mutation rates of non-protospacer bases following BE3-mediated correction of the cancer-associated p53 Y163C mutation in HCC1954 human cells. The DNA sequence of the 50 bases on either side of the protospacer from FIG. 30B

FIGS. 36A to 36F show the effects of deaminase, linker length, and linker composition on base editing. FIG. 36A shows a gel-based deaminase assay showing activity of rAPOBEC1, pmCDA1, hAID, hAPOBEC3G, rAPOBEC1-GGS-dCas9, rAPOBEC1-(GGS)$_3$(SEQ ID NO: 596)-dCas9, and dCas9-(GGS)$_3$(SEQ ID NO: 596)-rAPOBEC1 on ssDNA. Enzymes were expressed in a mammalian cell lysate-derived in vitro transcription-translation system and incubated with 1.8 µM dye-conjugated ssDNA and USER enzyme (uracil DNA glycosylase and endonuclease VIII) at 37° C. for 2 hours. The resulting DNA was resolved on a denaturing polyacrylamide gel and imaged. The positive control is a sequence with a U synthetically incorporated at the same position as the target C. FIG. 36B shows coomassie-stained denaturing PAGE gel of the expressed and purified proteins used in FIGS. 36C to 36F. FIGS. 36C to 36F show gel-based deaminase assay showing the deamination window of base editors with deaminase-Cas9 linkers of GGS (FIG. 36C), (GGS)$_3$ (SEQ ID NO: 596) (FIG. 36D), XTEN (FIG. 36E), or (GGS)$_7$ (SEQ ID NO: 597) (FIG.

36F). Following incubation of 1.85 μM deaminase-dCas9 fusions complexed with sgRNA with 125 nM dsDNA substrates at 37° C. for 2 hours, the dye-conjugated DNA was isolated and incubated with USER enzyme at 37° C. for 1 hour to cleave the DNA backbone at the site of any uracils. The resulting DNA was resolved on a denaturing polyacrylamide gel, and the dye-conjugated strand was imaged. Each lane is numbered according to the position of the target C within the protospacer, or with—if no target C is present. 8U is a positive control sequence with a U synthetically incorporated at position 8.

Figure 37B:
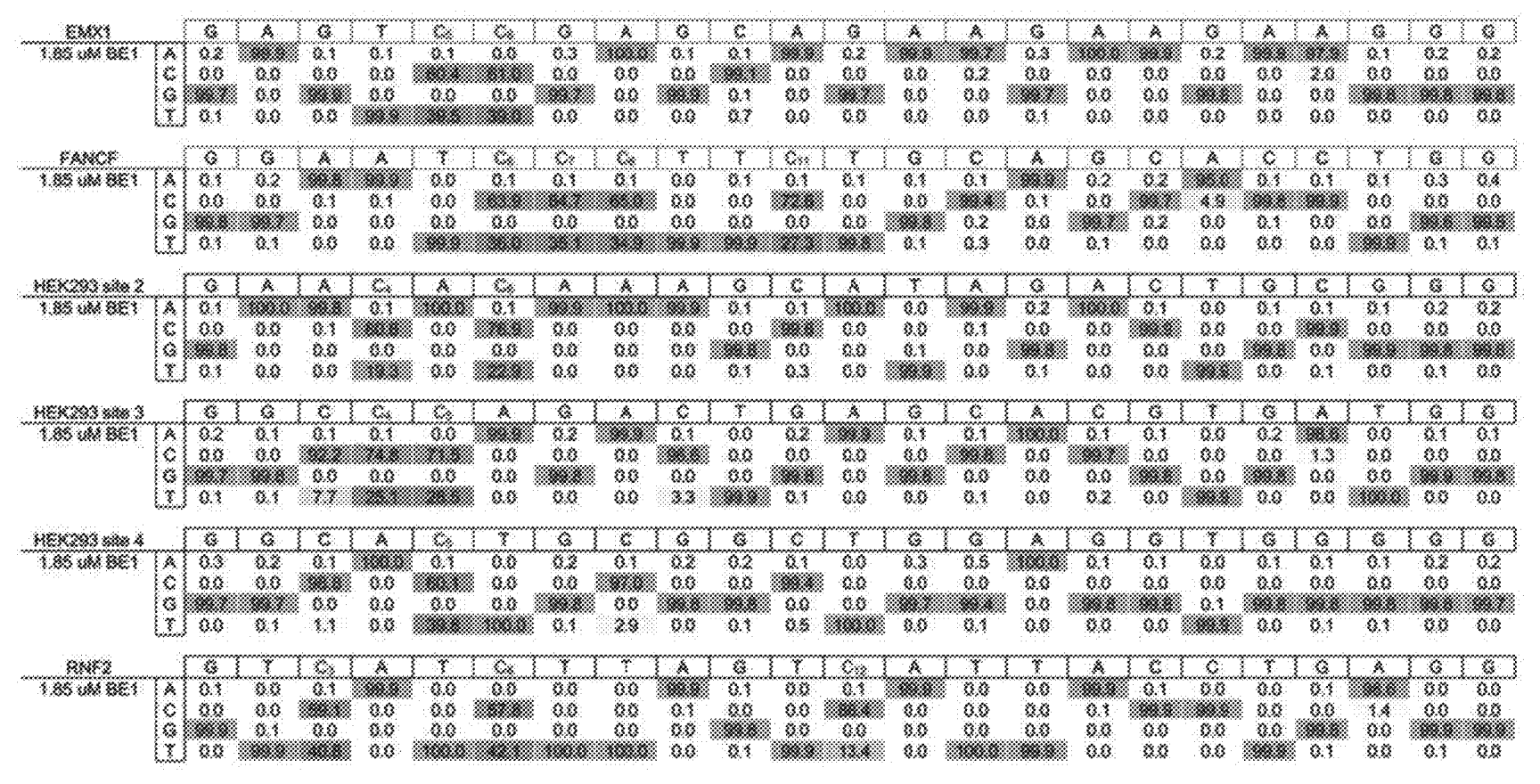
Figure 37C:
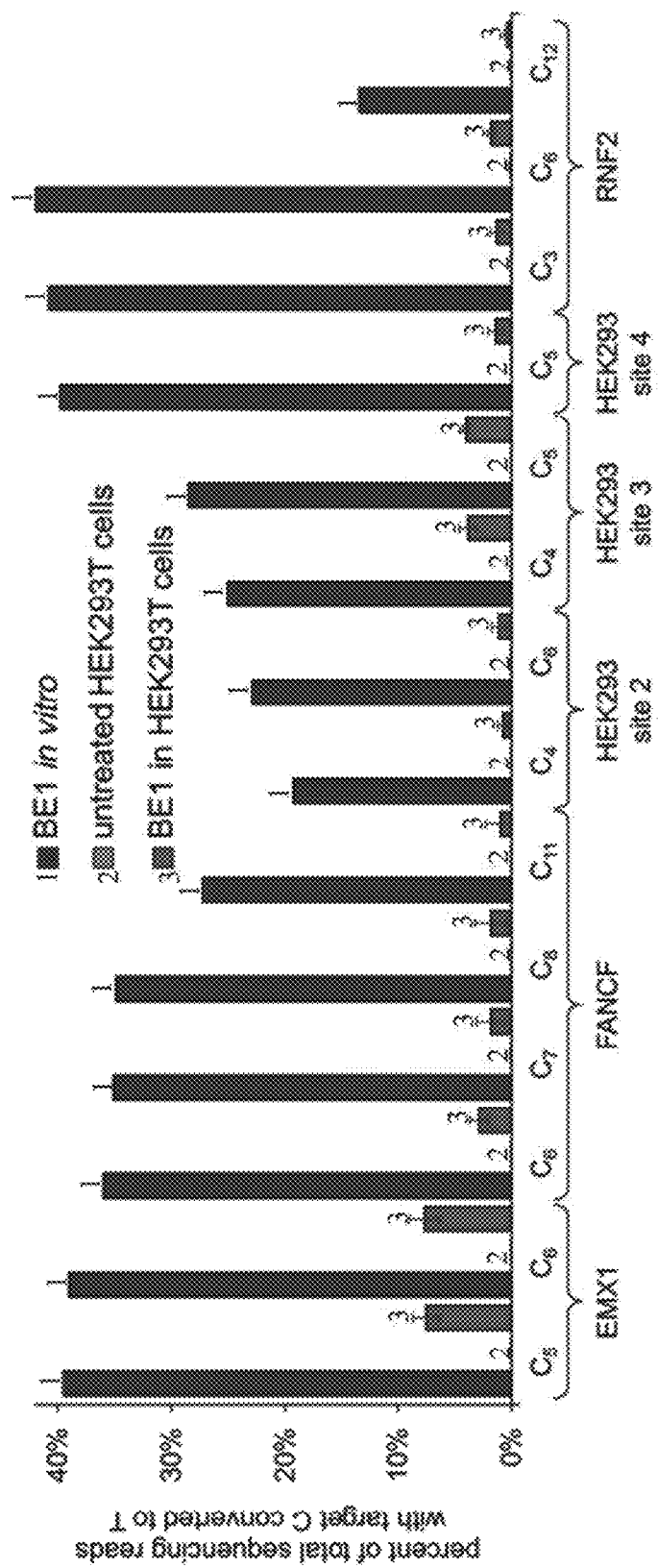

FIGS. 37A to 37C show BE1 base editing efficiencies are dramatically decreased in mammalian cells. FIG. 37A Protospacer (black and red) and PAM (blue) sequences of the six mammalian cell genomic loci targeted by base editors. Target Cs are indicated in red with subscripted numbers corresponding to their positions within the protospacer. FIG. 37B shows synthetic 80-mers with sequences matching six different genomic sites were incubated with BE1 then analyzed for base editing by HTS. For each site, the sequence of the protospacer is indicated to the right of the name of the site, with the PAM highlighted in blue. Underneath each sequence are the percentages of total DNA sequencing reads with the corresponding base. We considered a target C as "editable" if the in vitro conversion efficiency is >10%. Note that maximum yields are 50% of total DNA sequencing reads since the non-targeted strand is unaffected by BE1. Values are shown from a single experiment. FIG. 37C shows HEK293T cells were transfected with plasmids expressing BE1 and an appropriate sgRNA. Three days after transfection, genomic DNA was extracted and analyzed by high-throughput DNA sequencing at the six loci. Cellular C to T conversion percentages, defined as the percentage of total DNA sequencing reads with Ts at the target positions indicated, are shown for BE1 at all six genomic loci. Values and error bars of all data from HEK293T cells reflect the mean and standard deviation of three independent biological replicates performed on different days. FIG. 37A depicts SEQ ID NOs: 293 through 298 from top to bottom, respectively. FIG. 37B depicts SEQ ID NOs: 293 through 298 from top to bottom, respectively.

Figure 38:
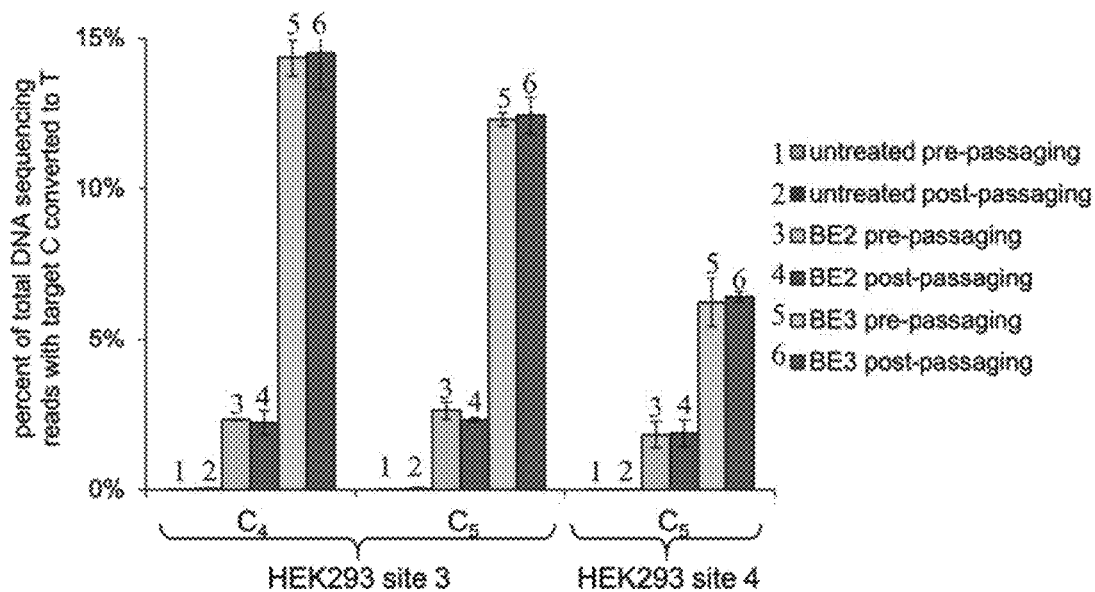

FIG. 38 shows base editing persists over multiple cell divisions. Cellular C to T conversion percentages by BE2 and BE3 are shown for HEK293 sites 3 and 4 in HEK293T cells before and after passaging the cells. HEK293T cells were nucleofected with plasmids expressing BE2 or BE3 and an sgRNA targeting HEK293 site 3 or 4. Three days after nucleofection, the cells were harvested and split in half. One half was subjected to HTS analysis, and the other half was allowed to propagate for approximately five cell divisions, then harvested and subjected to HTS analysis. Values and error bars reflect the mean and standard deviation of at least two biological experiments.

Figure 39A:
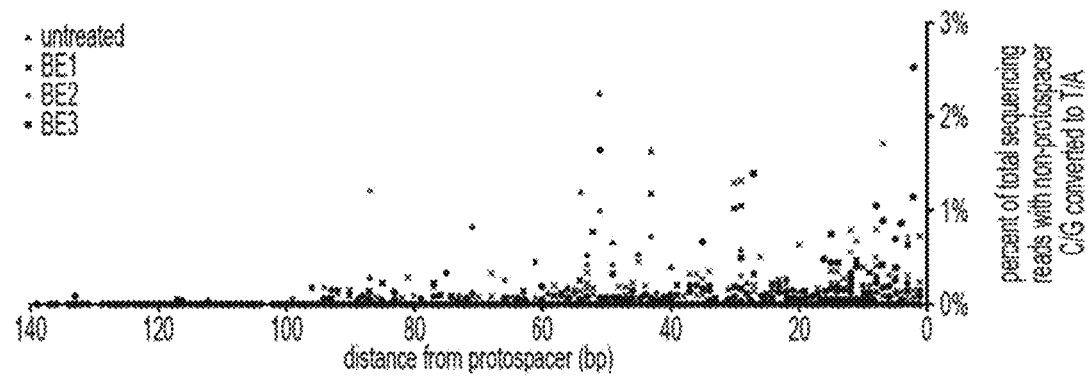
FIG. 39B is shown with each base's position relative to the protospacer. The side of the protospacer distal to the PAM is designated with positive numbers, while the side that includes the PAM is designated with negative numbers, with the PAM shown in blue. Underneath each sequence are the percentages of total sequencing reads with the corresponding base for untreated cells, for cells treated with BE3 and an sgRNA targeting the TP53 Y163C mutation, or for cells treated with BE3 and an sgRNA targeting the VEGFA locus. Neither BE3-treated sample resulted in mutational rates above those of untreated controls. This figure depicts SEQ ID NOs: 717 to 720 from top to bottom, respectively.
Figures 39B, 39C:
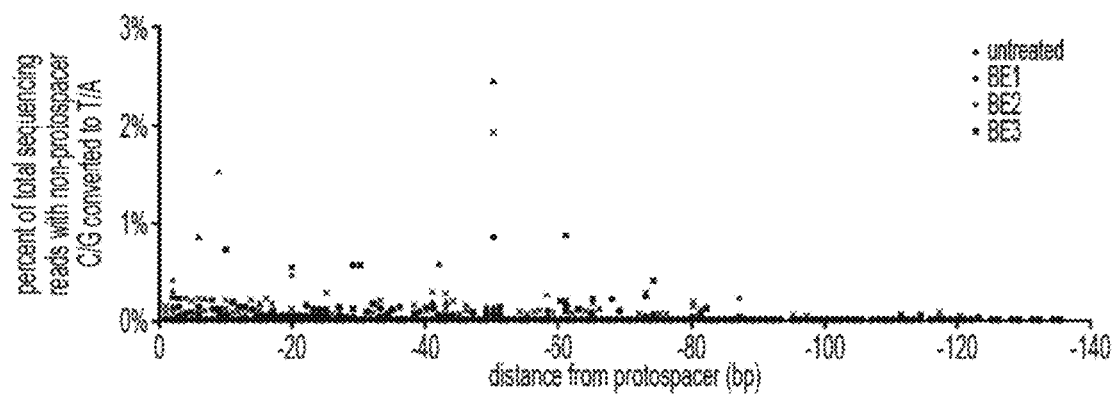

FIGS. 39A to 39C show non-target C/G mutation rates. Shown here are the C to T and G to A mutation rates at 2,500 distinct cytosines and guanines surrounding the six on-target and 34 off-target loci tested, representing a total of 14,700,000 sequence reads derived from approximately $1.8 \times 10^6$ cells. FIGS. 39A and 39B show cellular non-target C to T and G to A conversion percentages by BE1, BE2, and BE3 are plotted individually against their positions relative to a protospacer for all 2,500 cytosines/guanines. The side of the protospacer distal to the PAM is designated with positive numbers, while the side that includes the PAM is designated with negative numbers. FIG. 39C shows average non-target cellular C to T and G to A conversion percentages by BE1, BE2, and BE3 are shown, as well as the highest and lowest individual conversion percentages.

Figure 40A:
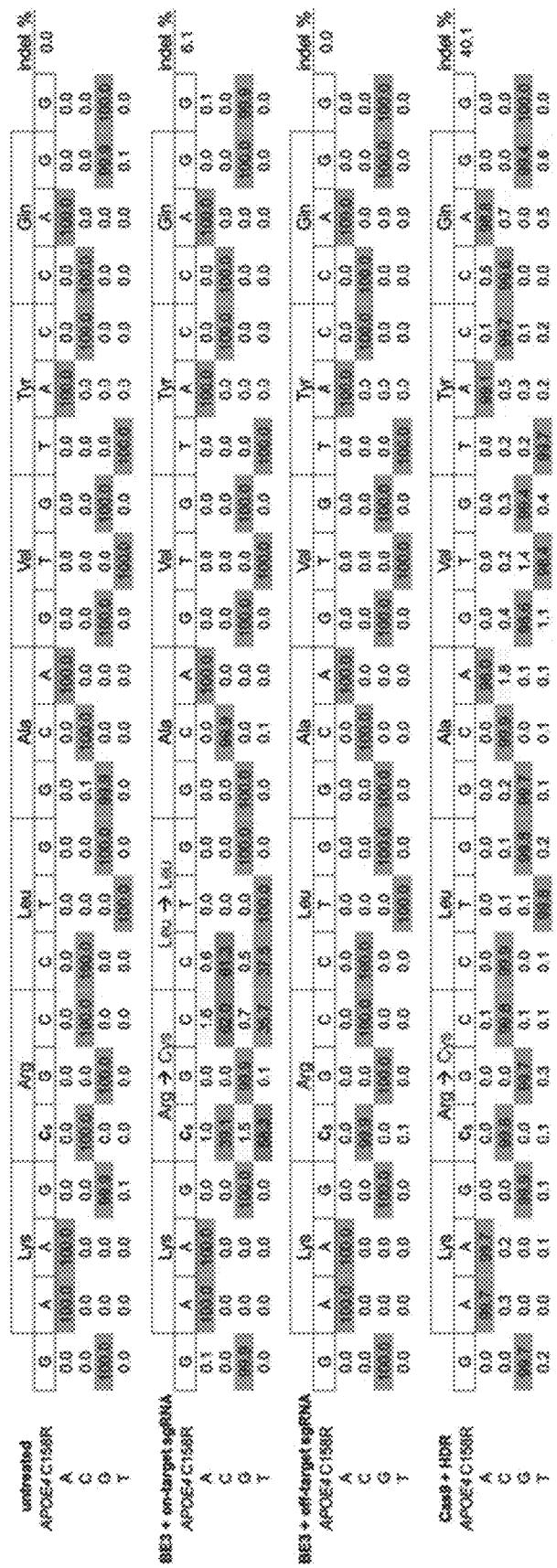
Figure 40B:
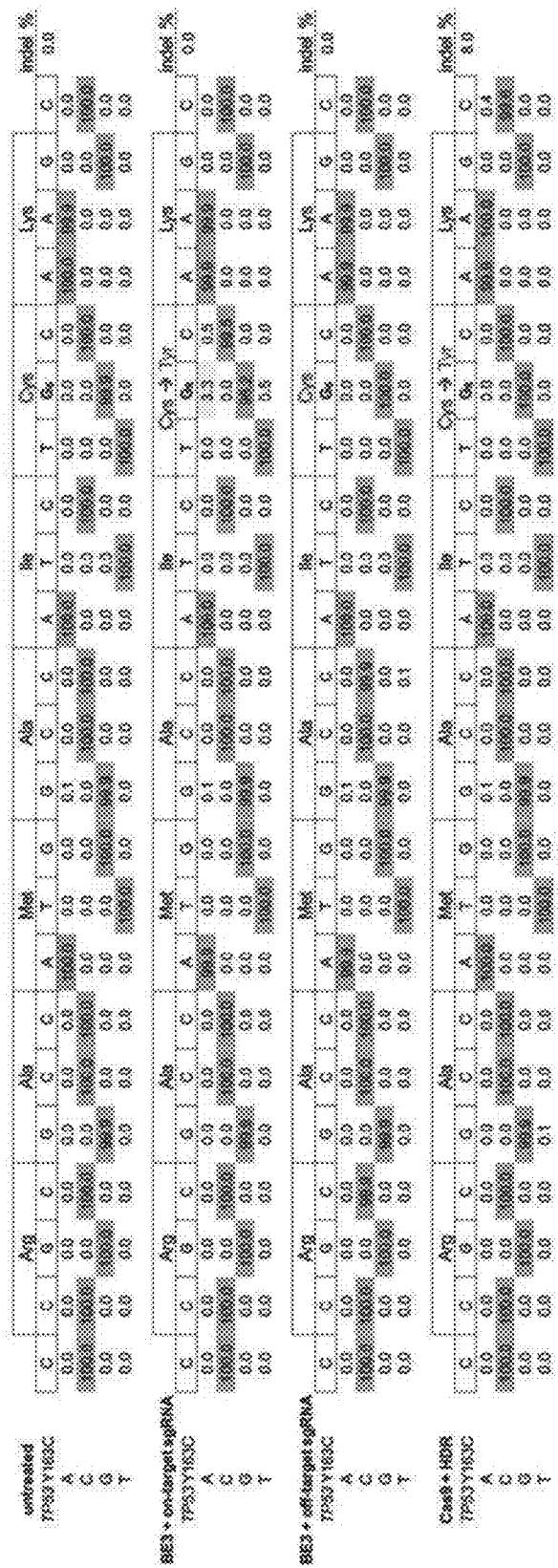

FIGS. 40A to 40B show additional data sets of BE3-mediated correction of two disease-relevant mutations in mammalian cells. For each site, the sequence of the protospacer is indicated to the right of the name of the mutation, with the PAM highlighted in blue and the base responsible for the mutation indicated in red bold with a subscripted number corresponding to its position within the protospacer. The amino acid sequence above each disease-associated allele is shown, together with the corrected amino acid sequence following base editing in green. Underneath each sequence are the percentages of total sequencing reads with the corresponding base. Cells were nucleofected with plasmids encoding BE3 and an appropriate sgRNA. Two days after nucleofection, genomic DNA was extracted from the nucleofected cells and analyzed by HTS to assess pathogenic mutation correction. FIG. 40A shows the Alzheimer's disease-associated APOE4 allele is converted to APOE3r in mouse astrocytes by BE3 in 58.3% of total reads only when treated with the correct sgRNA. Two nearby Cs are also converted to Ts, but with no change to the predicted sequence of the resulting protein. Identical treatment of these cells with wt Cas9 and donor ssDNA results in 0.2% correction, with 26.7% indel formation. FIG. 40B shows the cancer-associated p53 Y163C mutation is corrected by BE3 in 3.3% of nucleofected human breast cancer cells only when treated with the correct sgRNA. Identical treatment of these cells with wt Cas9 and donor ssDNA results in no detectable mutation correction with 8.0% indel formation. The amino acid sequences in FIG. 40A correspond to SEQ ID NOs: 675, 299, 675, and 299 from top to bottom, respectively. The nucleotide sequence is given by SEQ ID NO: 5747. The amino acid sequences in FIG. 40B correspond to SEQ ID NOs: 678, 301, 678, and 301 from top to bottom, respectively. The nucleotide sequence is given by SEQ ID NO: 5749.

Figure 41:
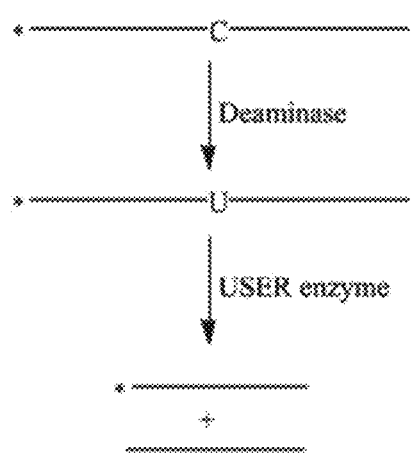

FIG. 41 shows a schematic representation of an exemplary USER (Uracil-Specific Excision Reagent) Enzyme-based assay, which may be used to test the activity of various deaminases on single-stranded DNA (ssDNA) substrates.

Figure 42:
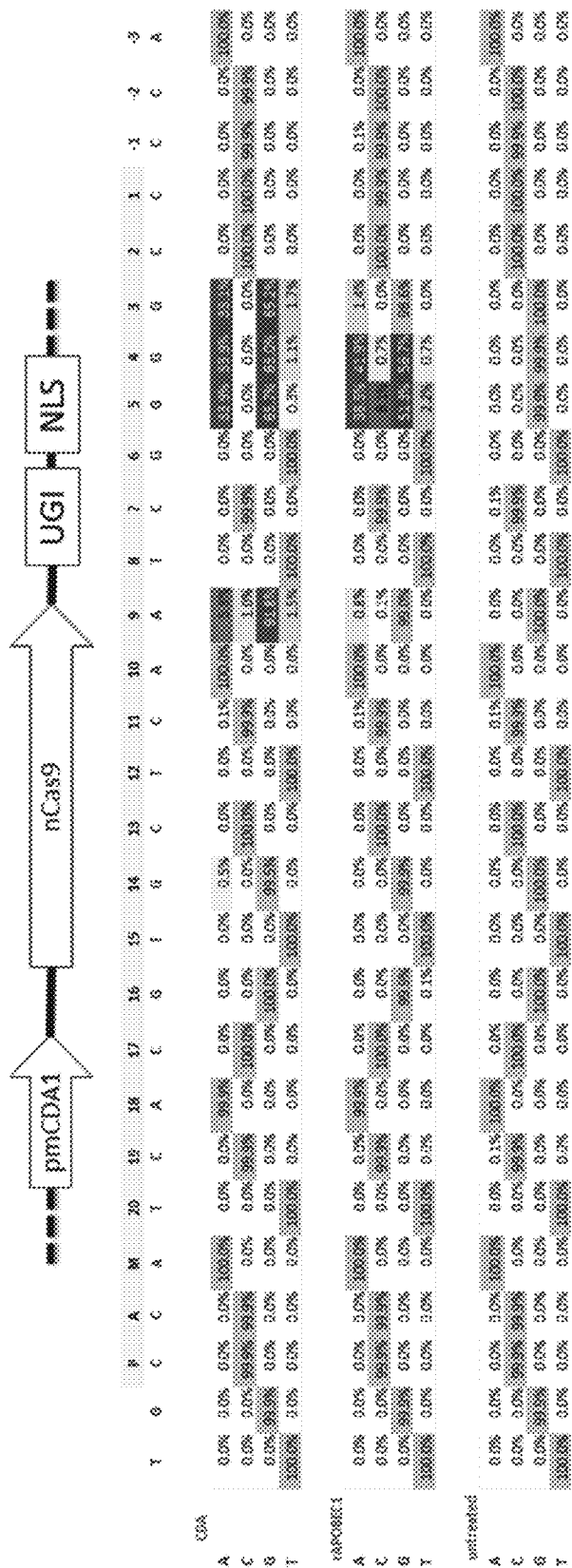

FIG. 42 is a schematic of the pmCDA-nCas9-UGI-NLS construct and its activity at the HeK-3 site relative to the base editor (rAPOBEC1) and the negative control (untreated). The sequence corresponds to SEQ ID NO: 4139.

Figure 43:
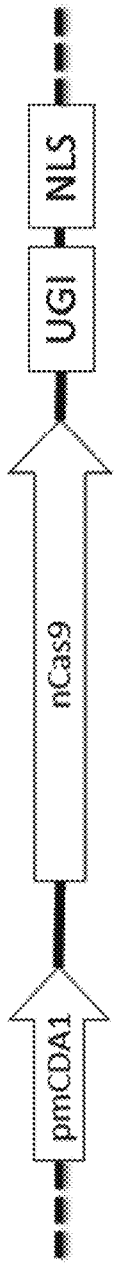

FIG. 43 is a schematic of the pmCDA1-XTEN-nCas9-UGI-NLS construct and its activity at the HeK-3 site relative to the base editor (rAPOBEC1) and the negative control (untreated). The sequence corresponds to SEQ ID NO: 4140.

Figure 44:
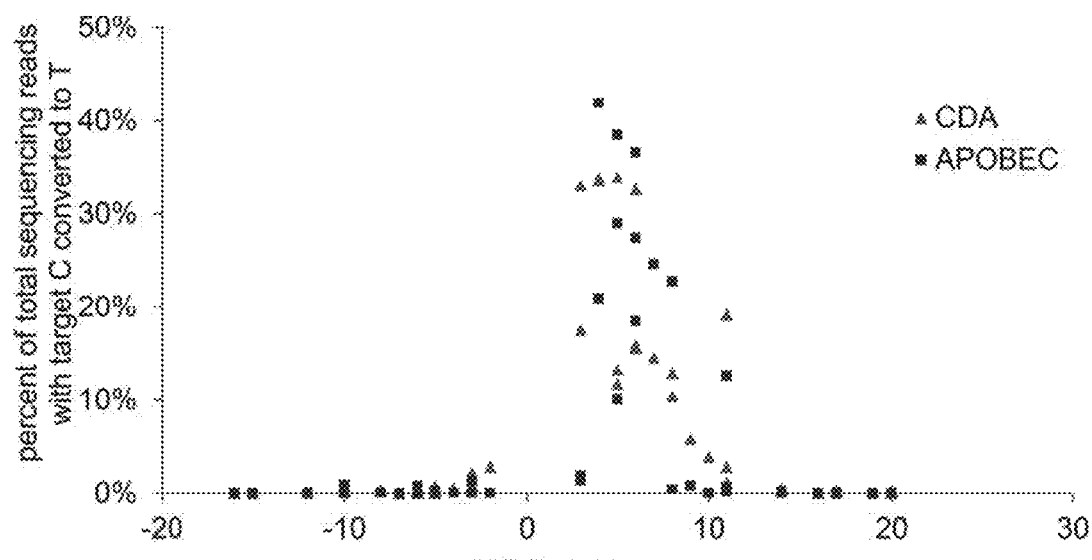

FIG. 44 shows the percent of total sequencing reads with target C converted to T using cytidine deaminases (CDA) or APOBEC.

Figure 45:
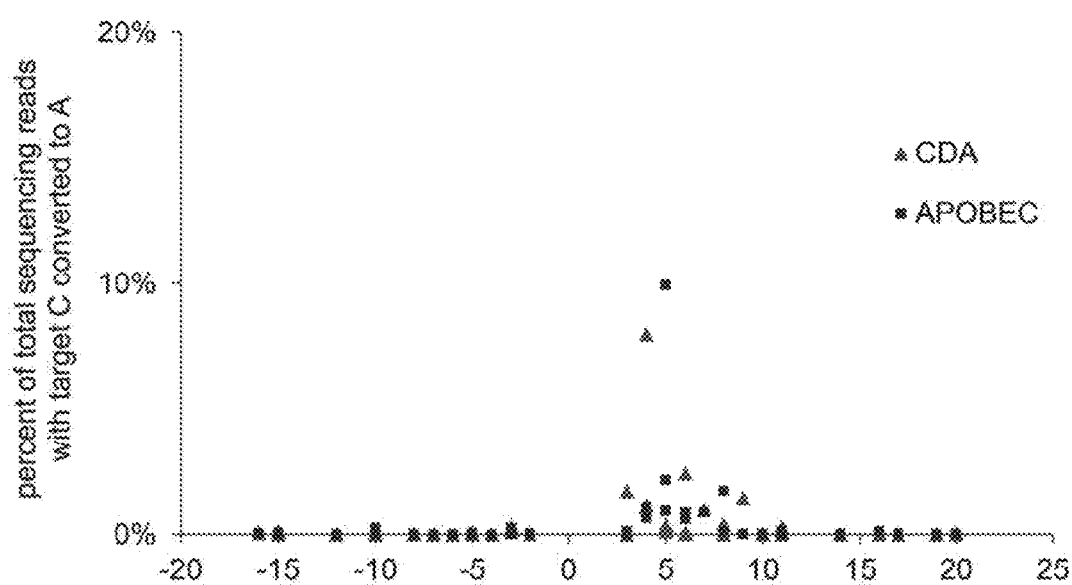

FIG. 45 shows the percent of total sequencing reads with target C converted to A using deaminases (CDA) or APOBEC.

Figure 46:
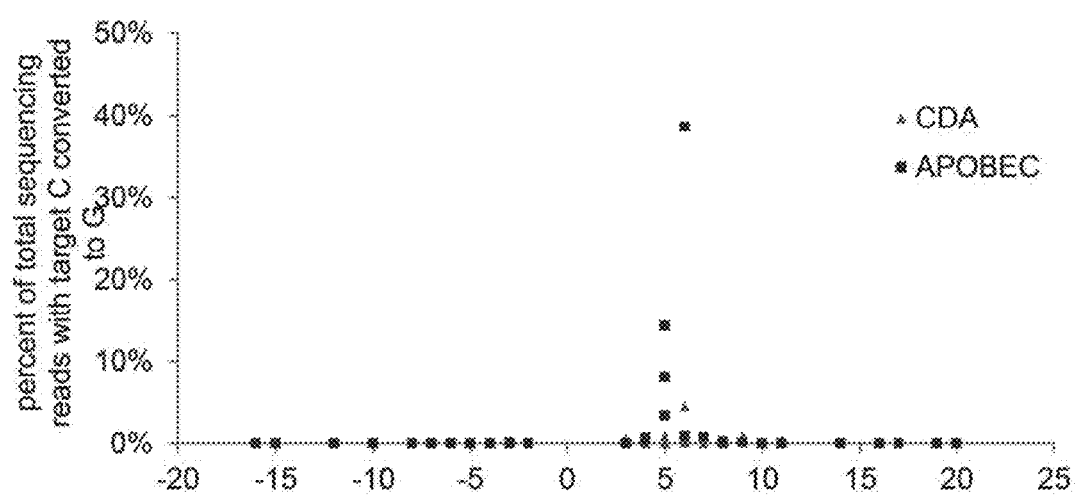

FIG. 46 shows the percent of total sequencing reads with target C converted to G using deaminases (CDA) or APOBEC.

Figure 47:
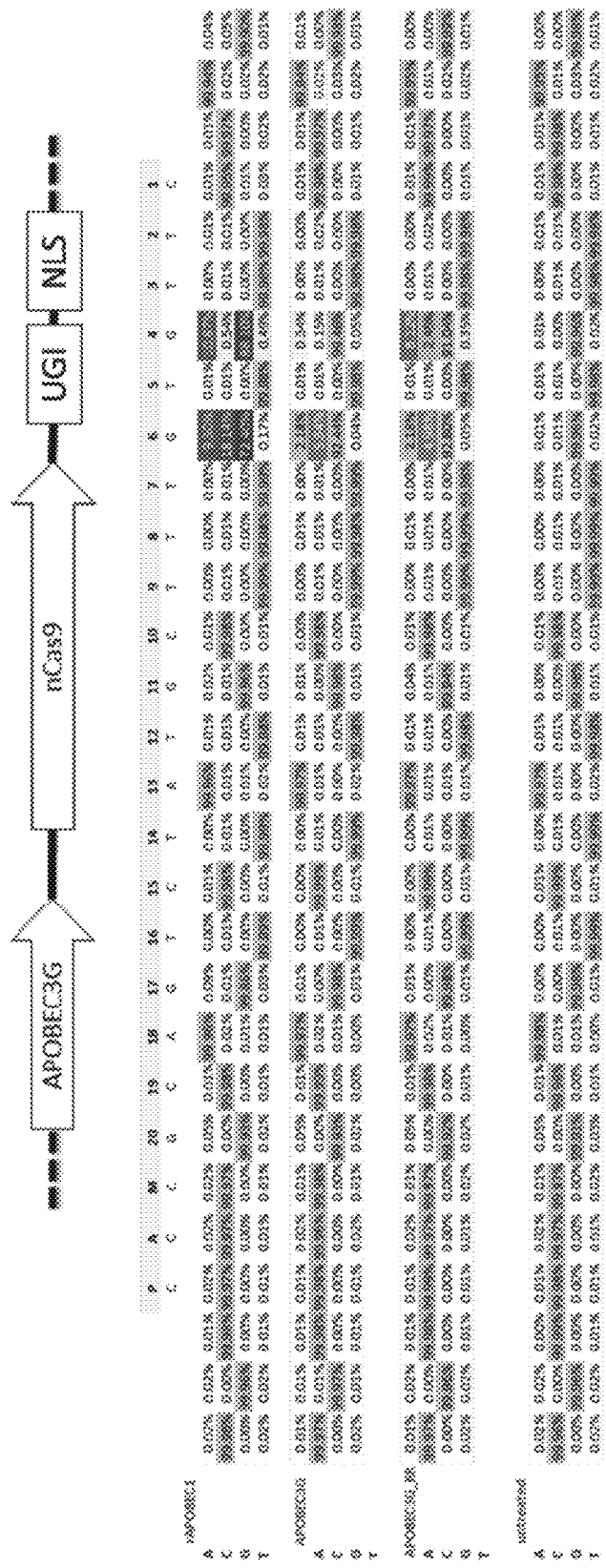

FIG. 47 is a schematic of the huAPOBEC3G-XTEN-nCas9-UGI-NLS construct and its activity at the HeK-2 site relative to a mutated form (huAPOBEC3G* (D316R_D317R)-XTEN-nCas9-UGI-NLS, the base editor (rAPOBEC1) and the negative control (untreated). The sequence corresponds to SEQ ID NO: 4141.

Figure 48:
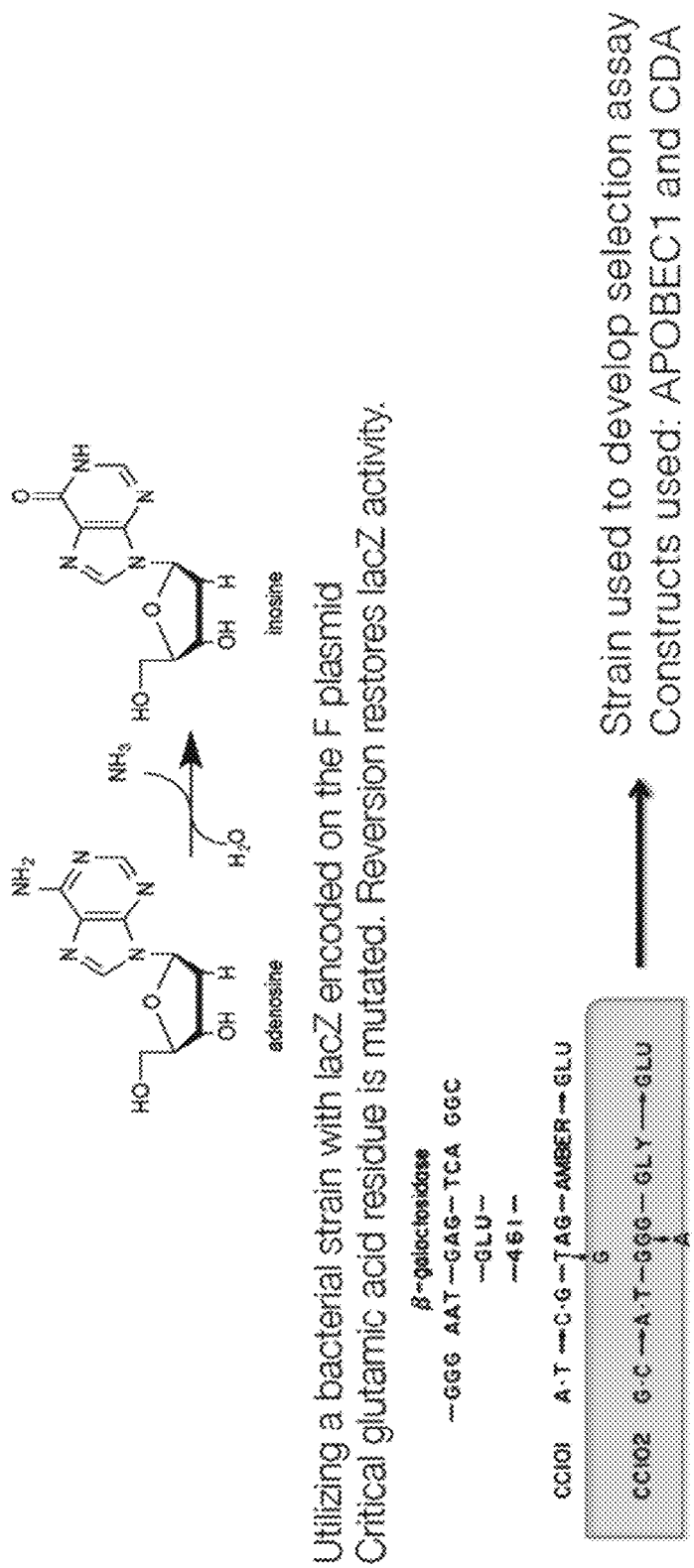

FIG. 48 shows the schematic of the LacZ construct used in the selection assay of Example 7. The sequence corresponds to SEQ ID NO: 4142.

FIG. 49 shows reversion data from different plasmids and constructs.

Figure 50:
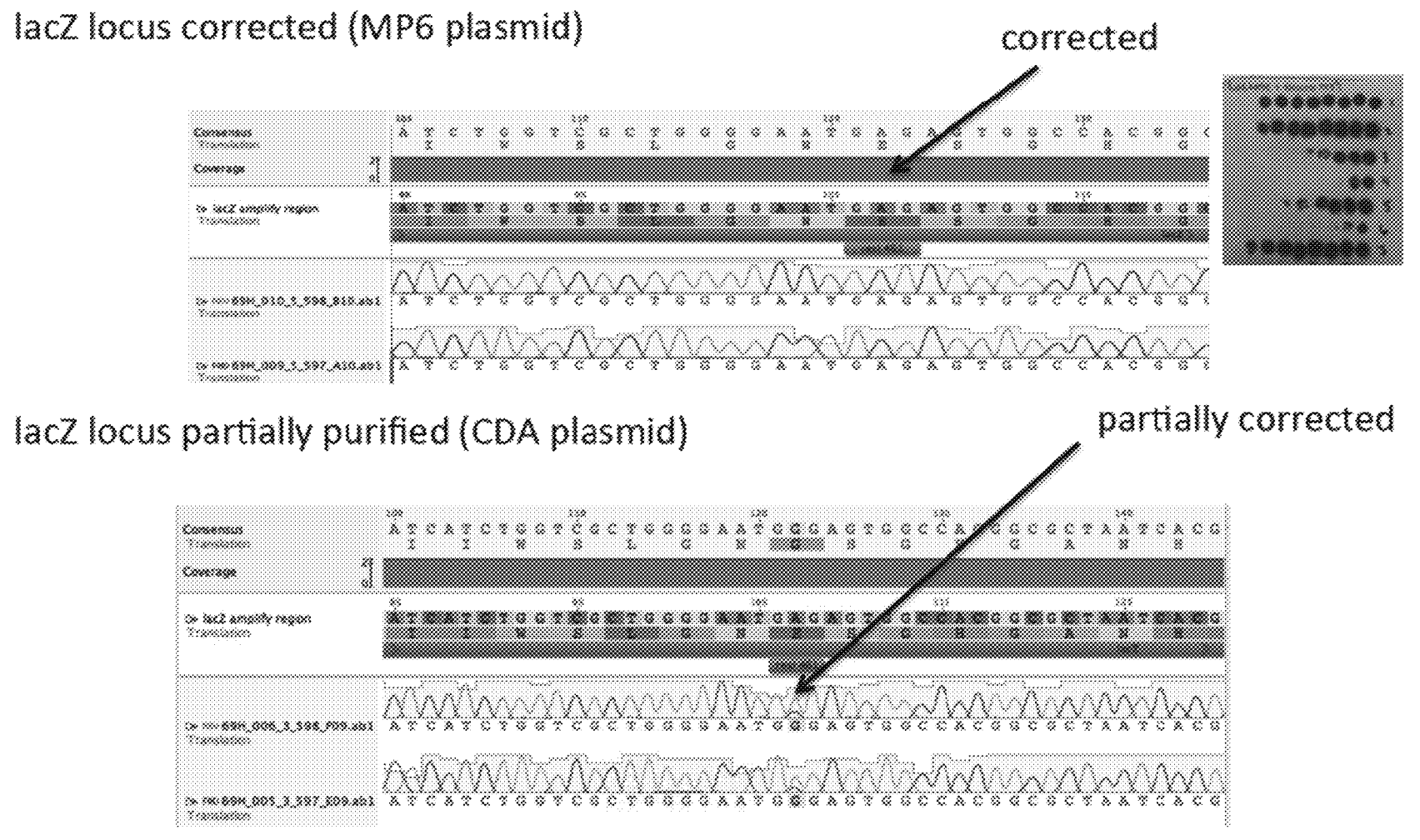

FIG. 50 shows the verification of lacZ reversion (the sequences correspond to SEQ ID NO: 4143 (the nucleotide sequence) and SEQ ID NO: 4144 (the amino acid sequence) from the MP6 plasmid) and the purification of reverted clones (the sequences correspond to SEQ ID NO: 4145 (the nucleotide sequence) and SEQ ID NO: 4146 (the amino acid sequence) from the CDA plasmid).

Figure 51:
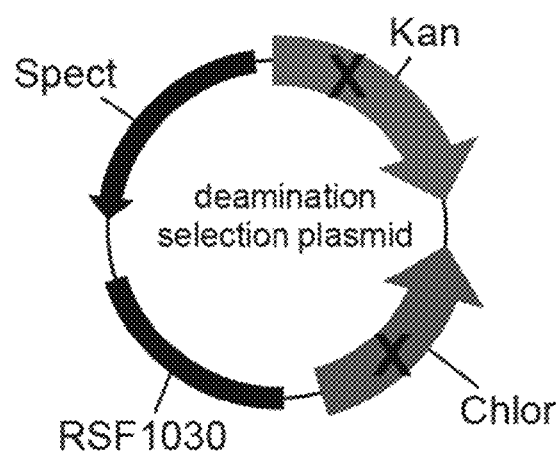

FIG. 51 is a schematic depicting a deamination selection plasmid used in Example 7.

Figure 52:
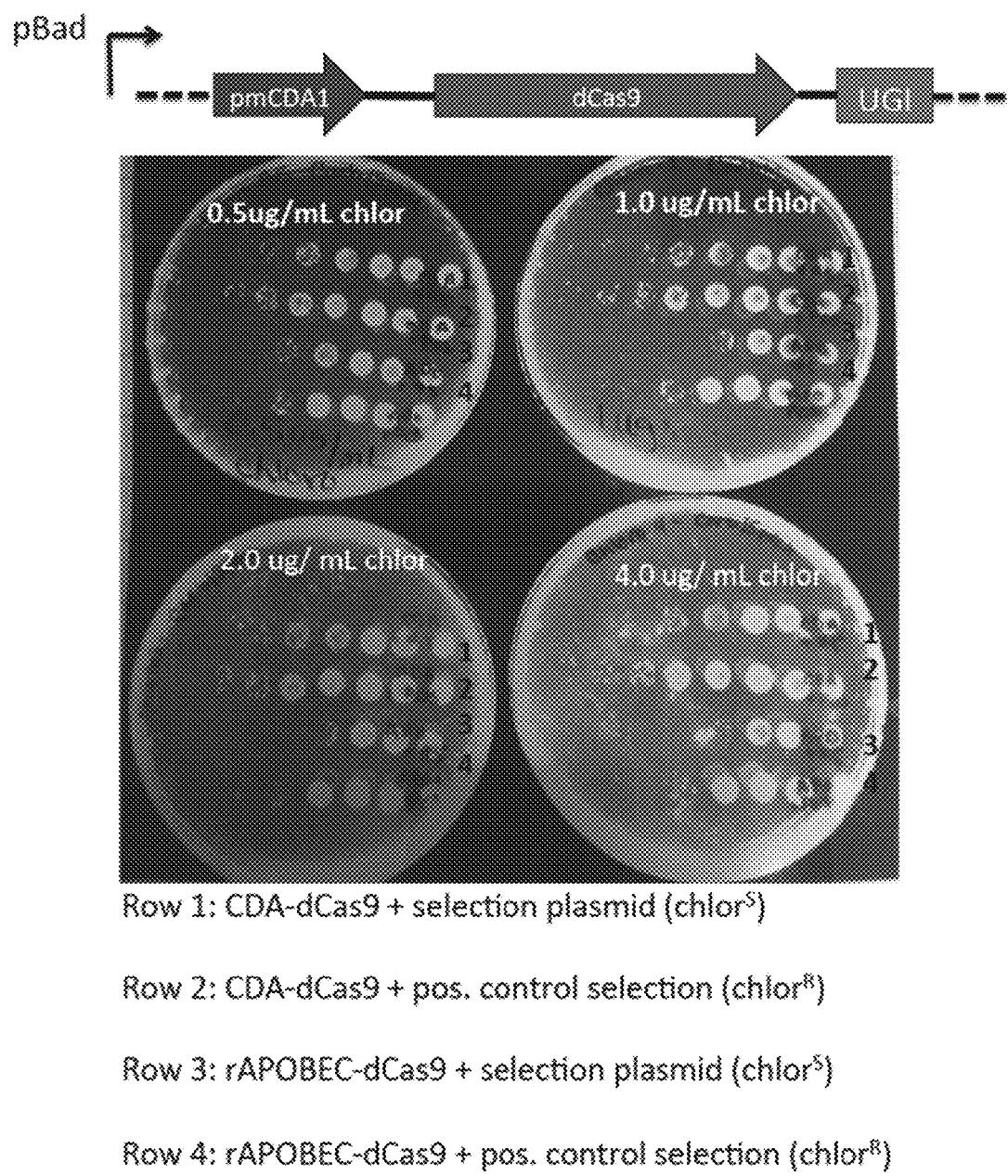

FIG. 52 shows the results of a chloramphenicol reversion assay (pmCDA1 fusion).

Figure 53A:
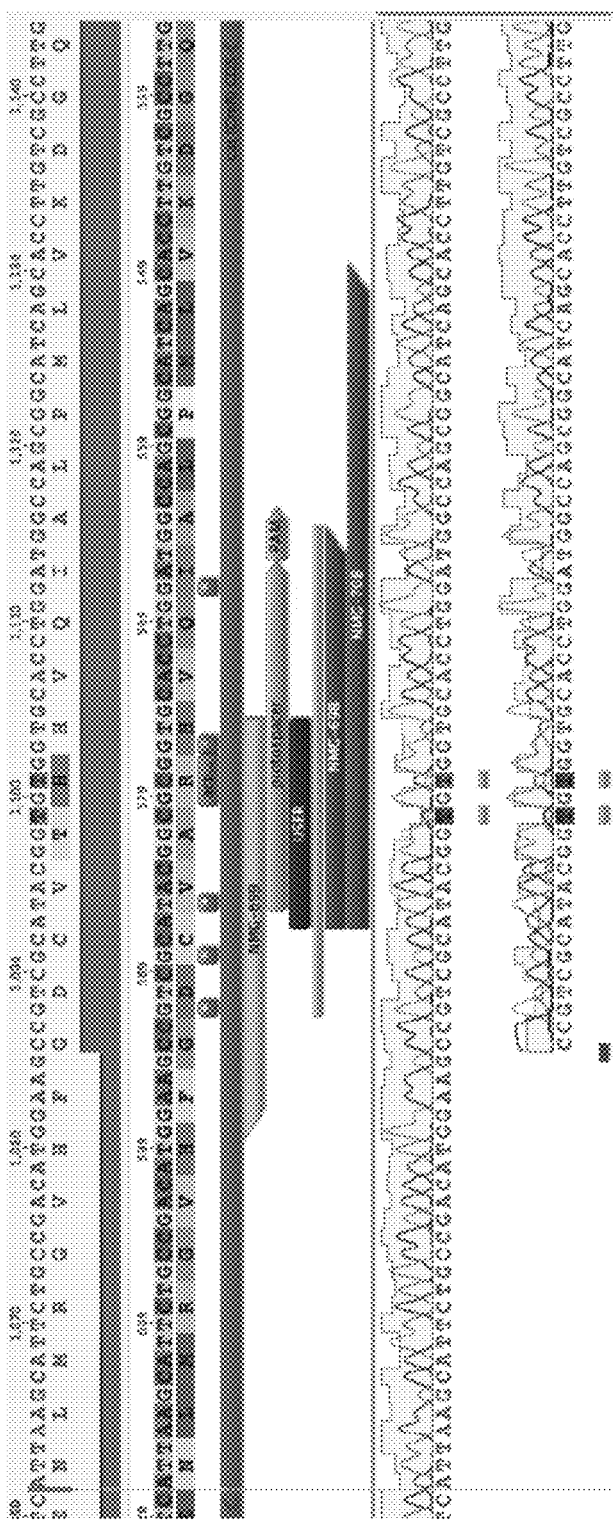
Figure 53B:
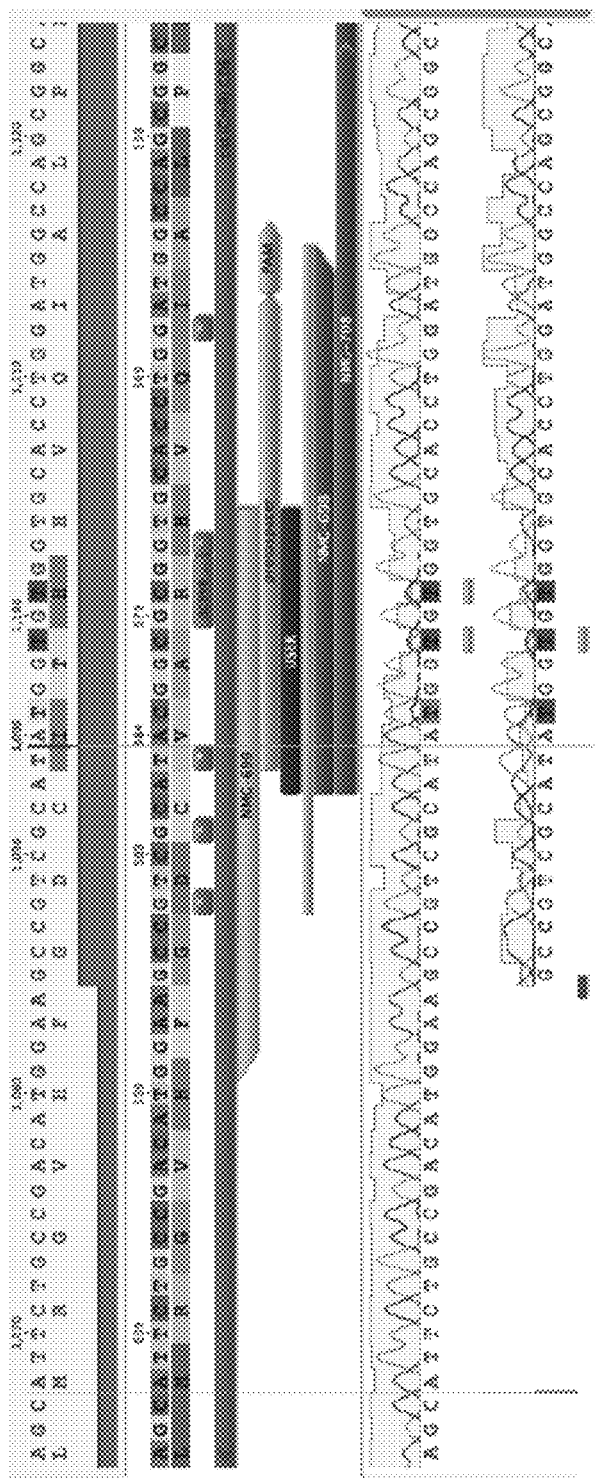

FIGS. 53A to 53B demonstrated DNA correction induction of two constructs. The sequences in FIG. 53A from top to bottom correspond to SEQ ID NOs: 4147 (the nucleotide sequence), 4148 (the amino acid sequence), 4149 (the nucleotide sequence), 4150 (the amino acid sequence), 4147 (the nucleotide sequence) and 4151 (the truncated nucleotide sequence). The sequences in FIG. 53B from top to bottom correspond to SEQ ID NOs: 5785 (the nucleotide sequence), 5787 (the amino acid sequence), 5786 (the nucleotide sequence), 5788 (the amino acid sequence), 5785 (the nucleotide sequence), and 5806 (the truncated nucleotide sequence).

Figure 54:
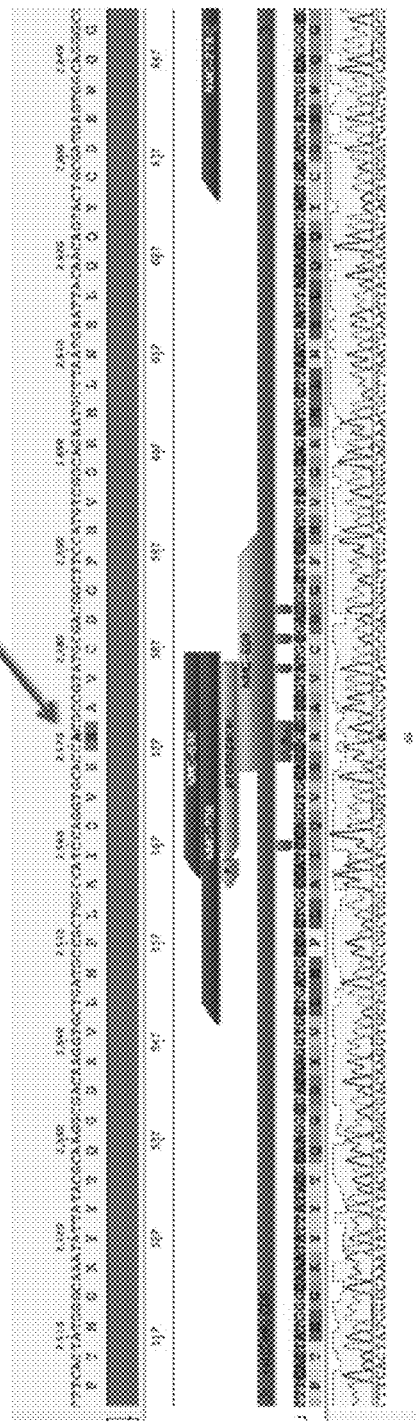

FIG. 54 shows the results of a chloramphenicol reversion assay (huAPOBEC3G fusion). The sequences correspond to SEQ ID NOs: 5802 (the nucleotide sequence), 5803 (the amino acid sequence), 5804 (the nucleotide sequence), 5805 (the amino acid sequence), and 5802 (the nucleotide sequence).

FIG. 55 shows the activities of BE3 and HF-BE3 at EMX1 off-targets. This figure depicts SEQ ID NOs: 293, and 5767 through 5775 from top to bottom, respectively.

Figure 56:
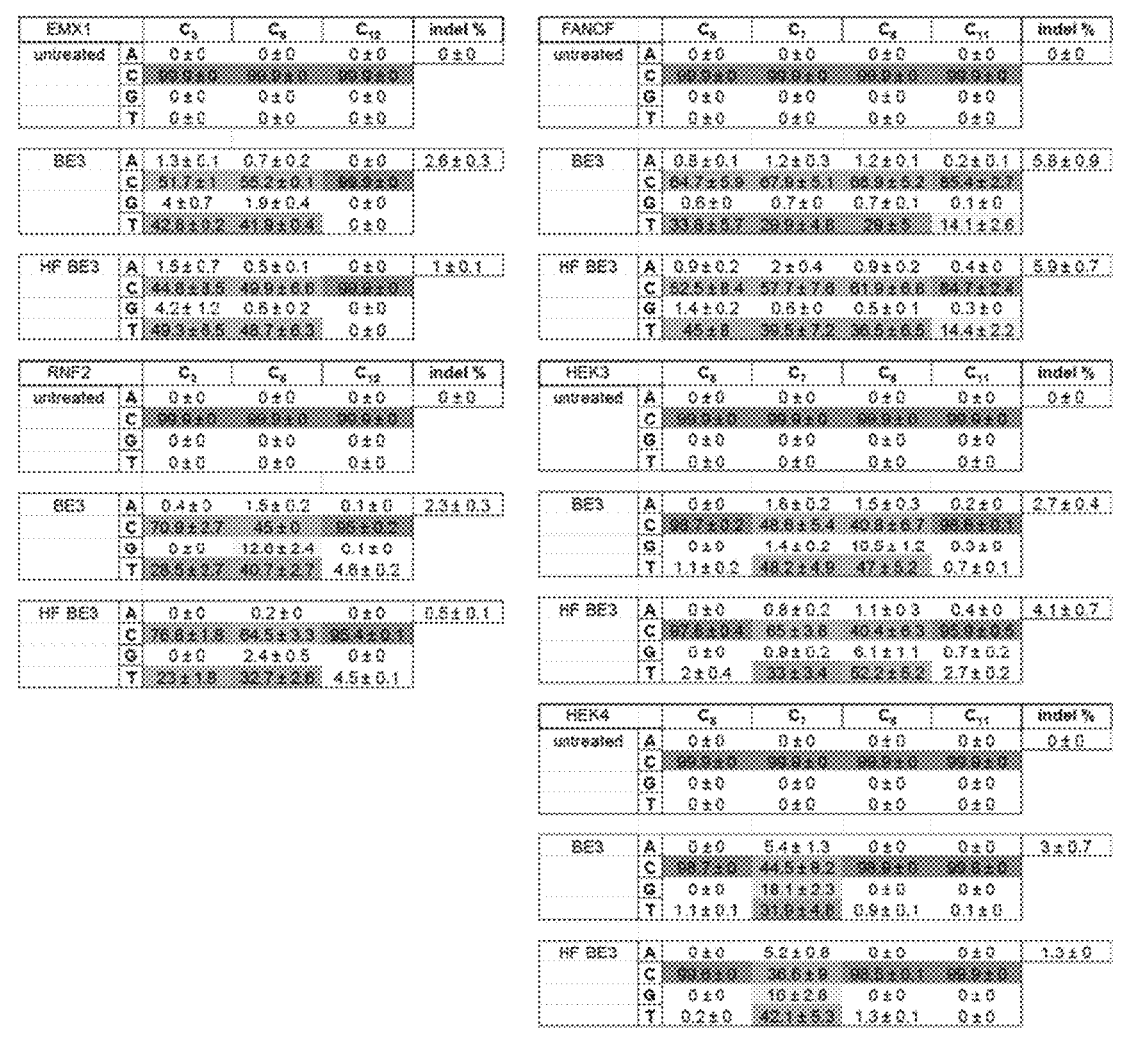

FIG. 56 shows on-target base editing efficiencies of BE3 and HF-BE3.

Figure 57:
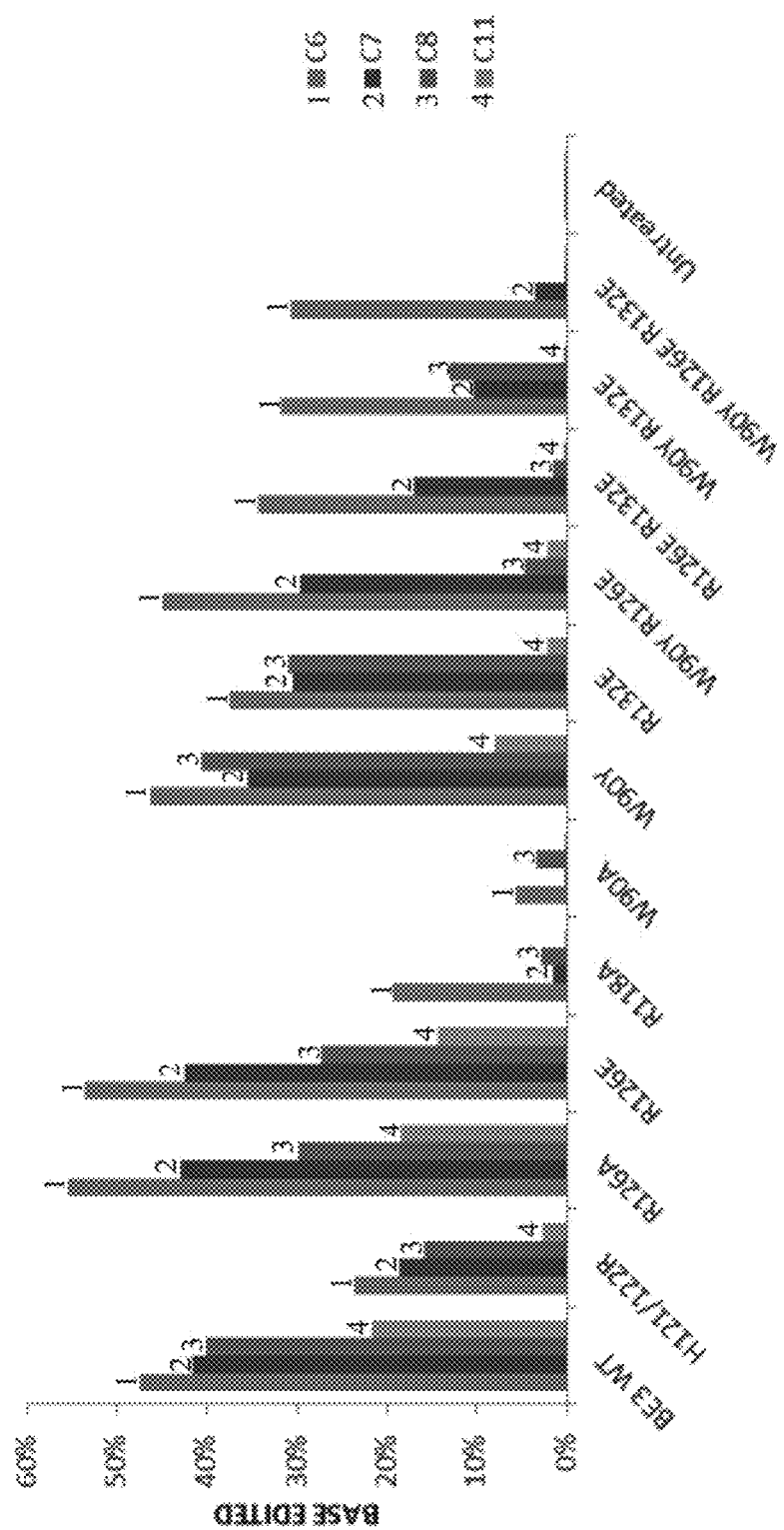

FIG. 57 is a graph demonstrating that mutations affect cytidine deamination with varying degrees. Combinations of mutations that each slightly impairs catalysis allow selective deamination at one position over others. The FANCF site was GGAATC$_6$C$_7$C$_8$TTC$_{11}$TGCAGCACCTGG (SEQ ID NO: 303).

Figure 58:
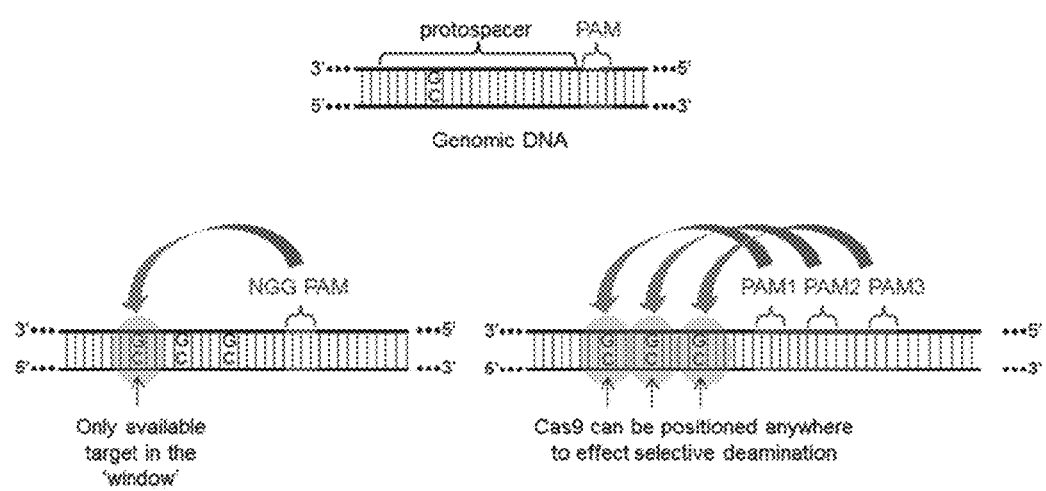

FIG. 58 is a schematic depicting next generation base editors.

Figure 59:
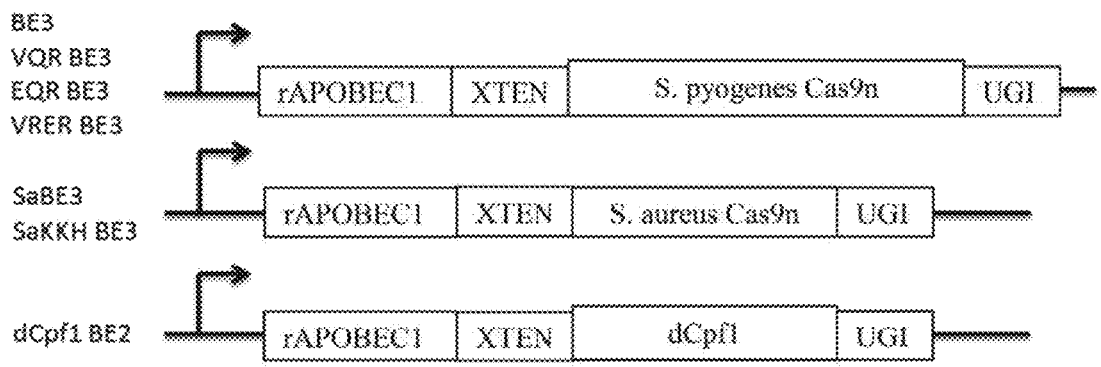

FIG. 59 is a schematic illustrating new base editors made from Cas9 variants.

Figure 60:
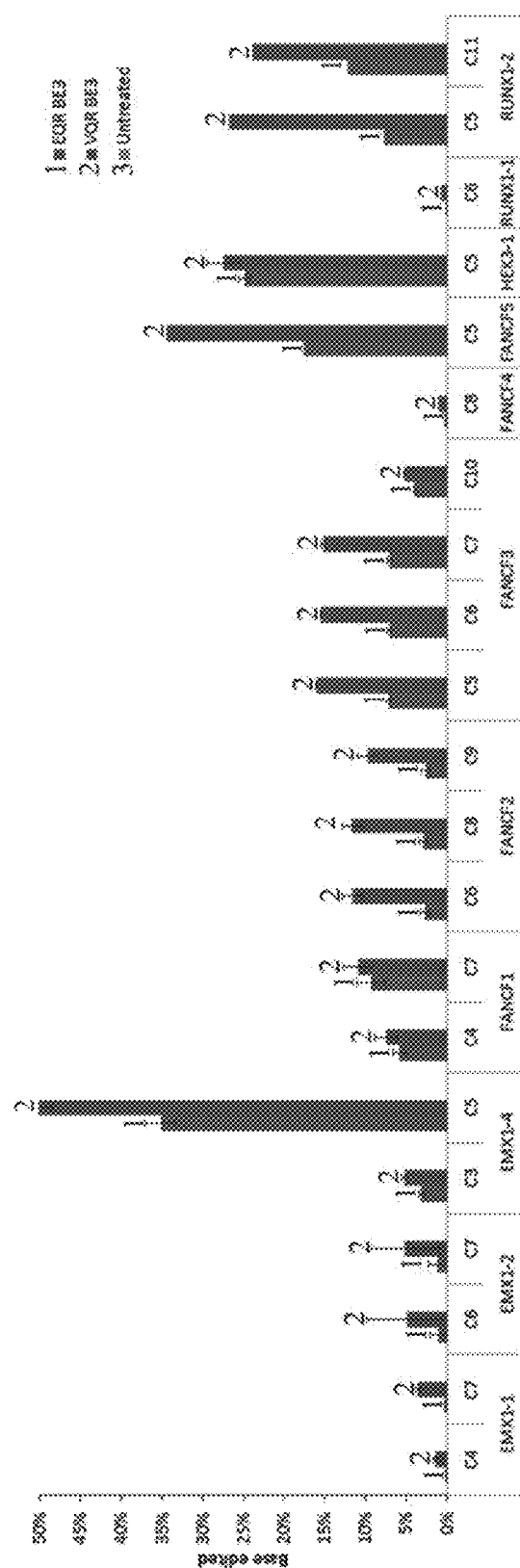

FIG. 60 shows the base-edited percentage of different NGA PAM sites.

Figure 61:
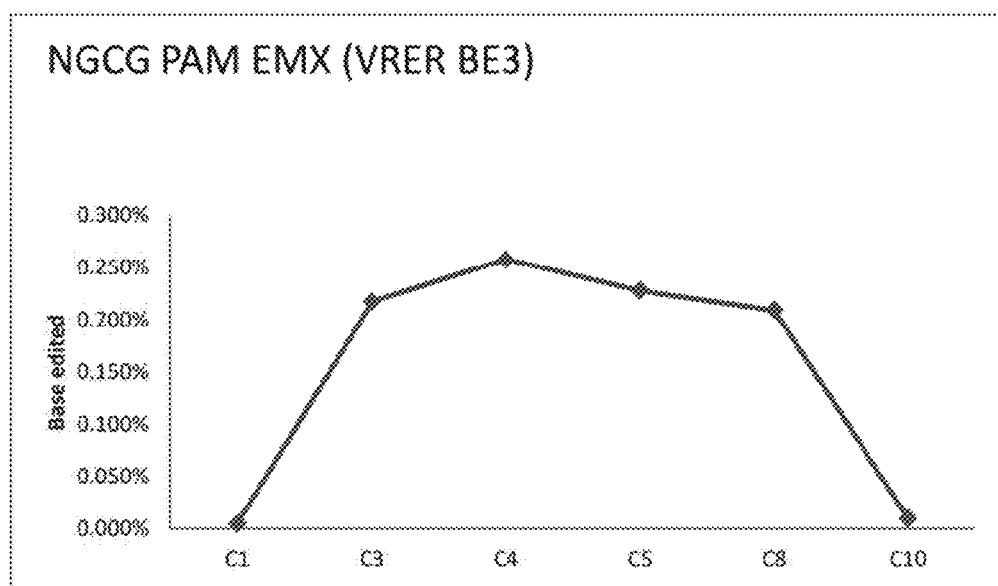

FIG. 61 shows the base-edited percentage of cytidines using NGCG PAM EMX (VRER BE3) and the C$_1$TC$_3$C$_4$C$_5$ATC$_8$AC$_{10}$ATCAACCGGT (SEQ ID NO: 304) spacer.

Figure 62:
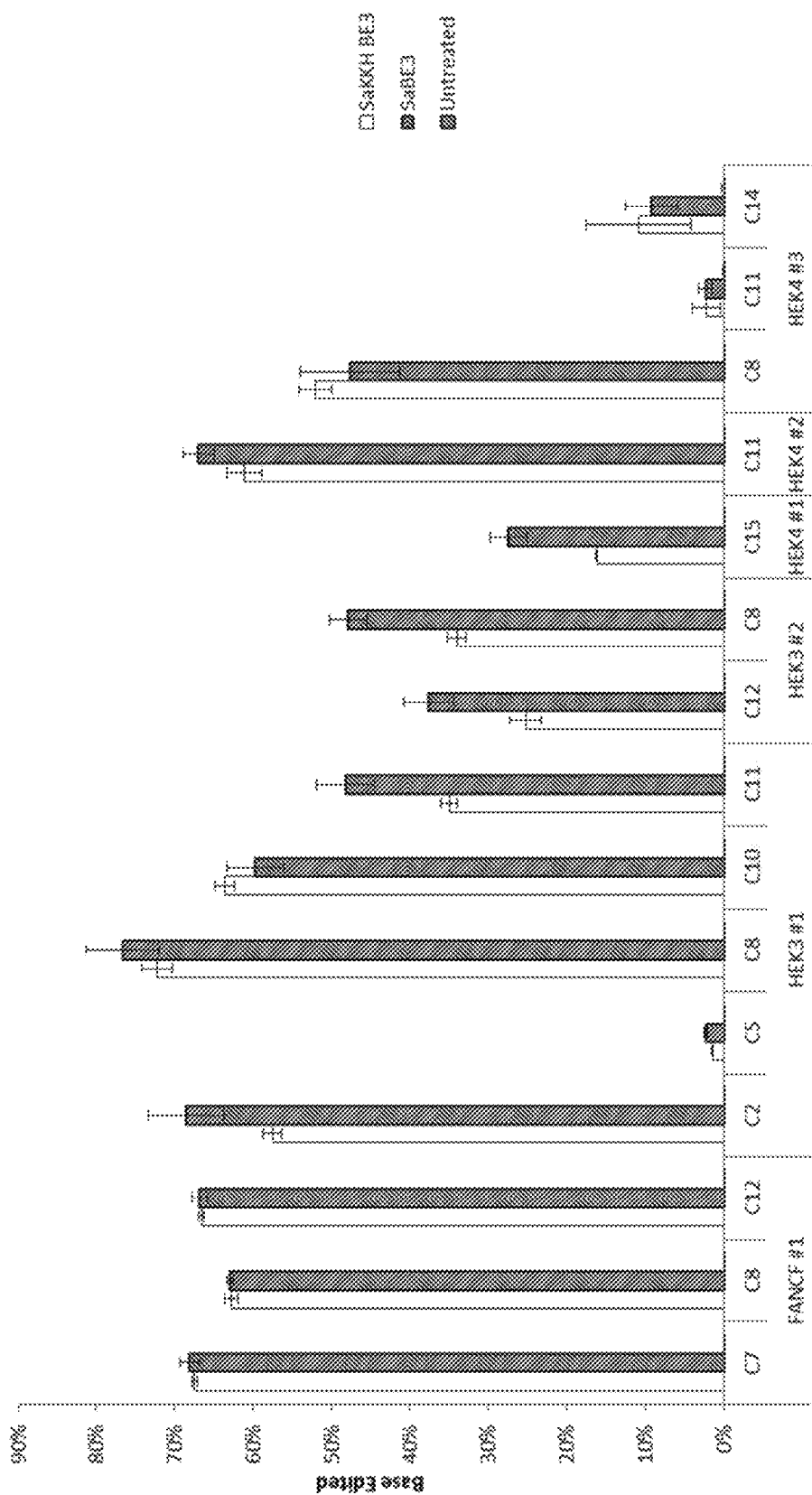

FIG. 62 shows the based-edited percentages resulting from different NNGRRT PAM sites.

Figure 63:
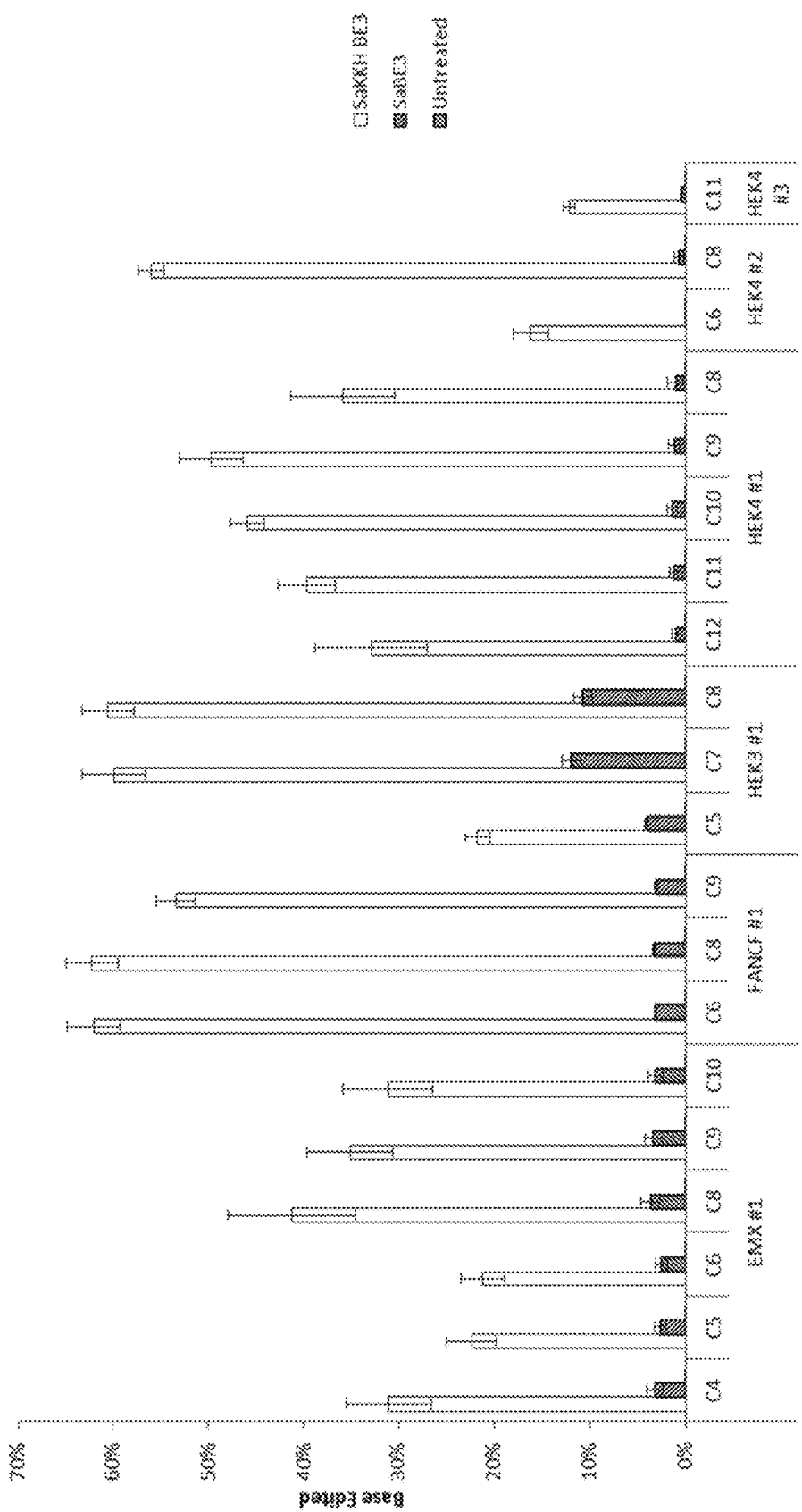

FIG. 63 shows the based-edited percentages resulting from different NNHRRT PAM sites.

Figure 64A:
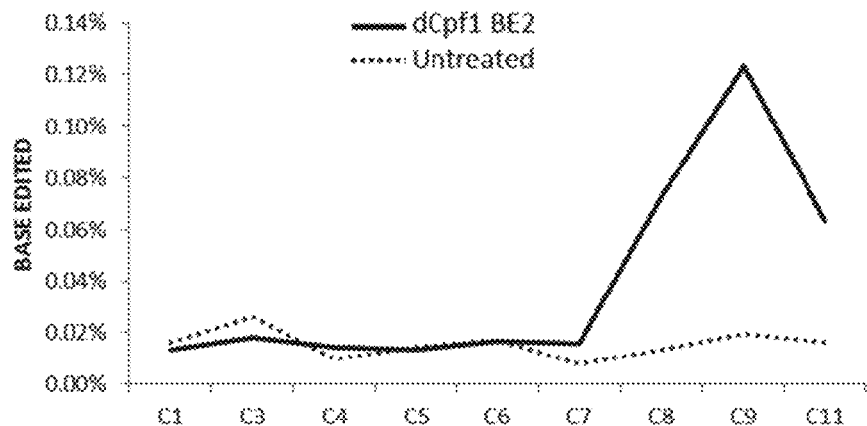
Figure 64B:
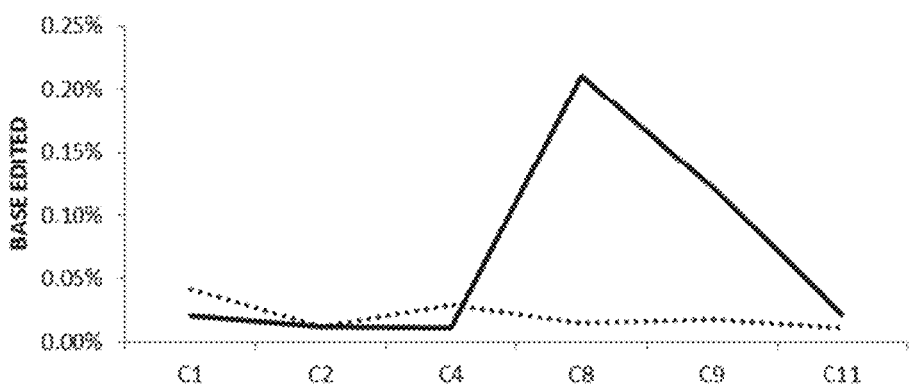
Figure 64C:
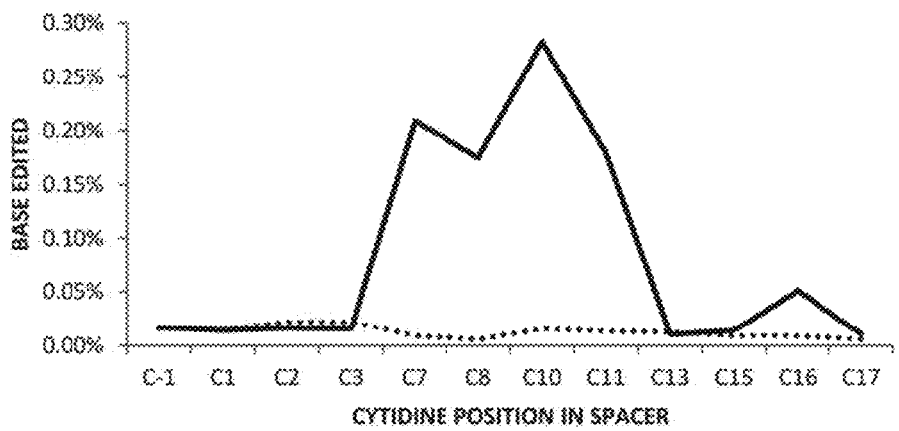

FIGS. 64A to 64C show the base-edited percentages resulting from different TTTN PAM sites using Cpf1 BE2. The spacers used were: TTTCCTC$_3$C$_4$C$_5$C$_6$C$_7$C$_8$C$_9$AC$_{11}$AGGTAGAACAT (FIG. 64A, SEQ ID NO: 305), TTTCC$_1$C$_2$TC$_4$TGTC$_8$C$_9$AC$_{11}$ACCCTCATCCTG (FIG. 64B, SEQ ID NO: 306), and TTTCC$_1$C$_2$C$_3$AGTC$_7$C$_8$TC$_{10}$C$_{11}$AC$_{13}$AC$_{15}$C$_{16}$C$_{17}$TGAAAC (FIG. 64C, SEQ ID NO: 307).

Figure 65:
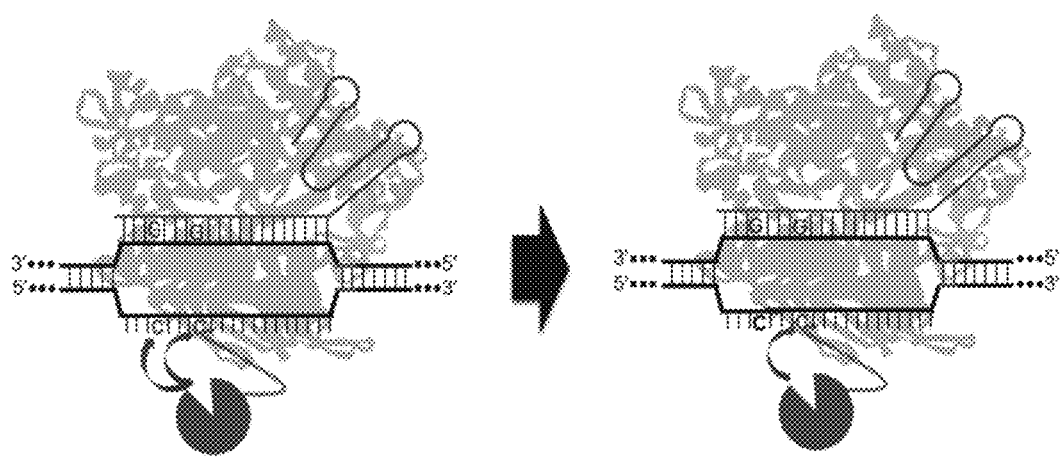

FIG. 65 is a schematic depicting selective deamination as achieved through kinetic modulation of cytidine deaminase point mutagenesis.

Figure 66:
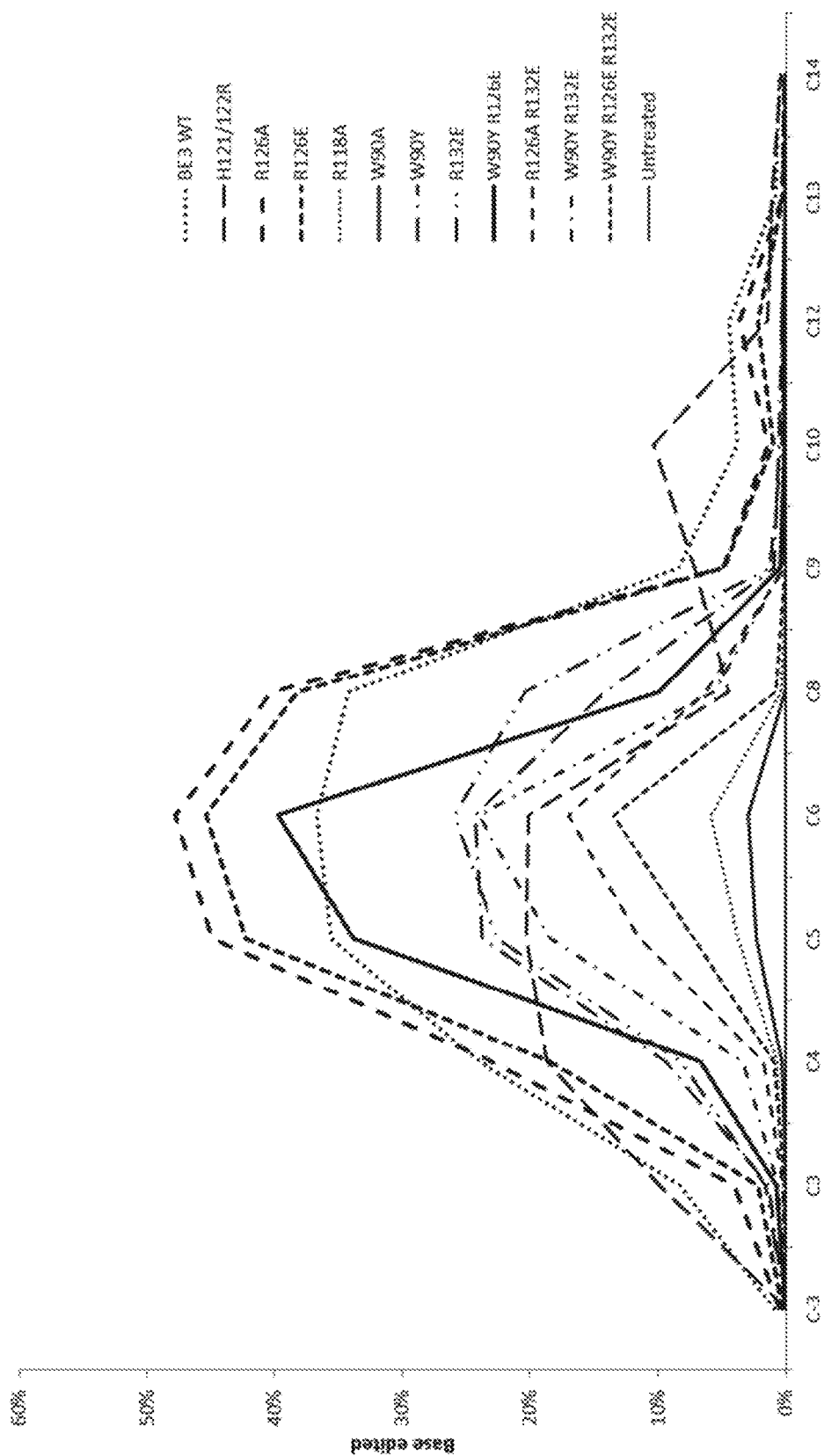

FIG. 66 is a graph showing the effect of various mutations on the deamination window probed in cell culture with multiple cytidines in the spacer. The spacer used was: TGC$_3$C$_4$C$_5$C$_6$TC$_8$C$_9$C$_{10}$TC$_{12}$C$_{13}$C$_{14}$TGGCCC (SEQ ID NO: 308).

Figure 67:
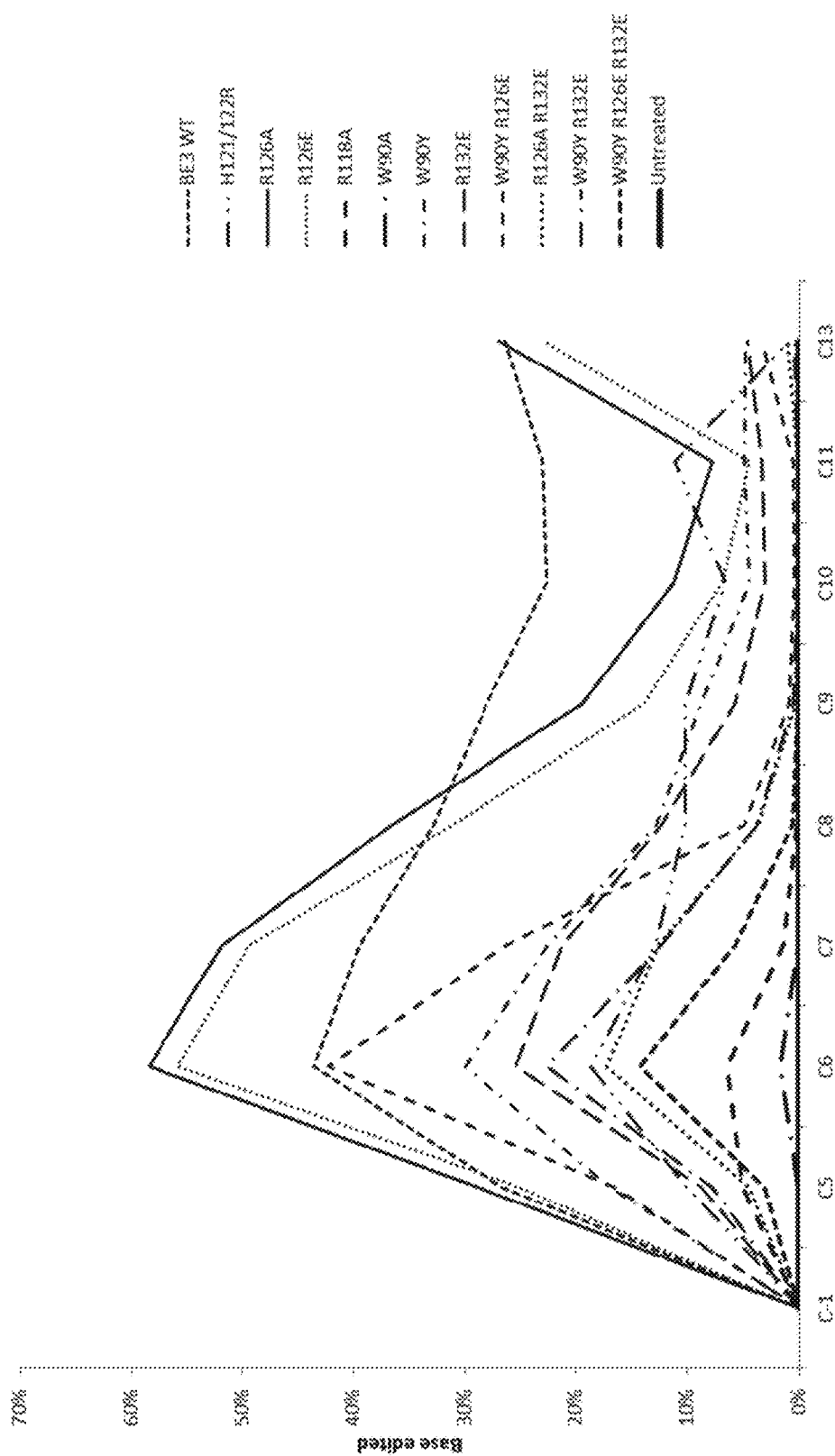

FIG. 67 is a graph showing the effect of various mutations on the deamination window probed in cell culture with multiple cytidines in the spacer. The spacer used was: AGAGC$_5$C$_6$C$_7$C$_8$C$_9$C$_{10}$C$_{11}$TC$_{13}$AAAGAGA (SEQ ID NO: 309).

Figure 68:
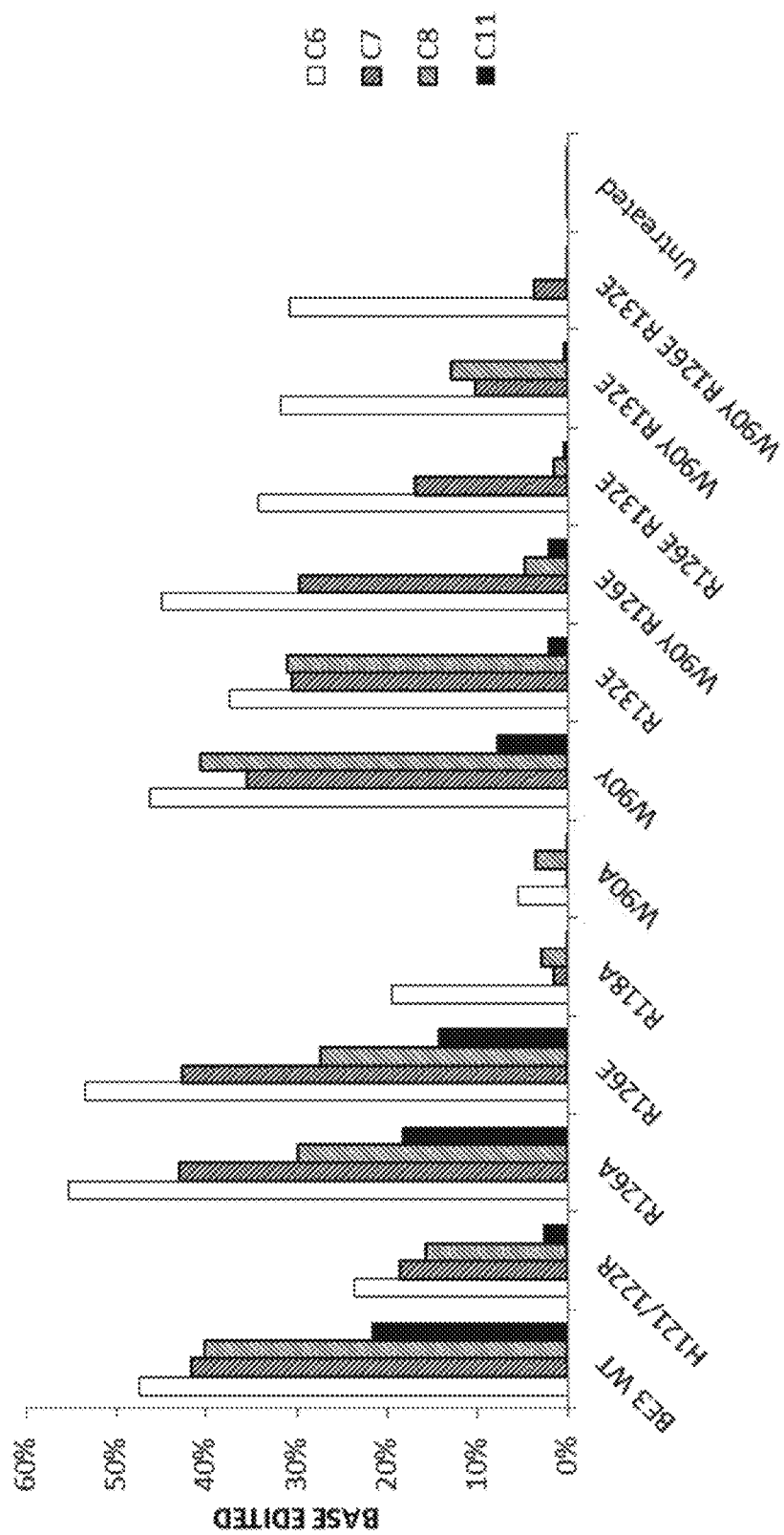

FIG. 68 is a graph showing the effect of various mutations on the FANCF site with a limited number of cytidines. The spacer used was: GGAATC$_6$C$_7$C$_8$TTC$_{11}$TGCAGCACCTGG (SEQ ID NO: 303). Note that the triple mutant (W90Y, R126E, R132E) preferentially edits the cytidine at the sixth position.

Figure 69:
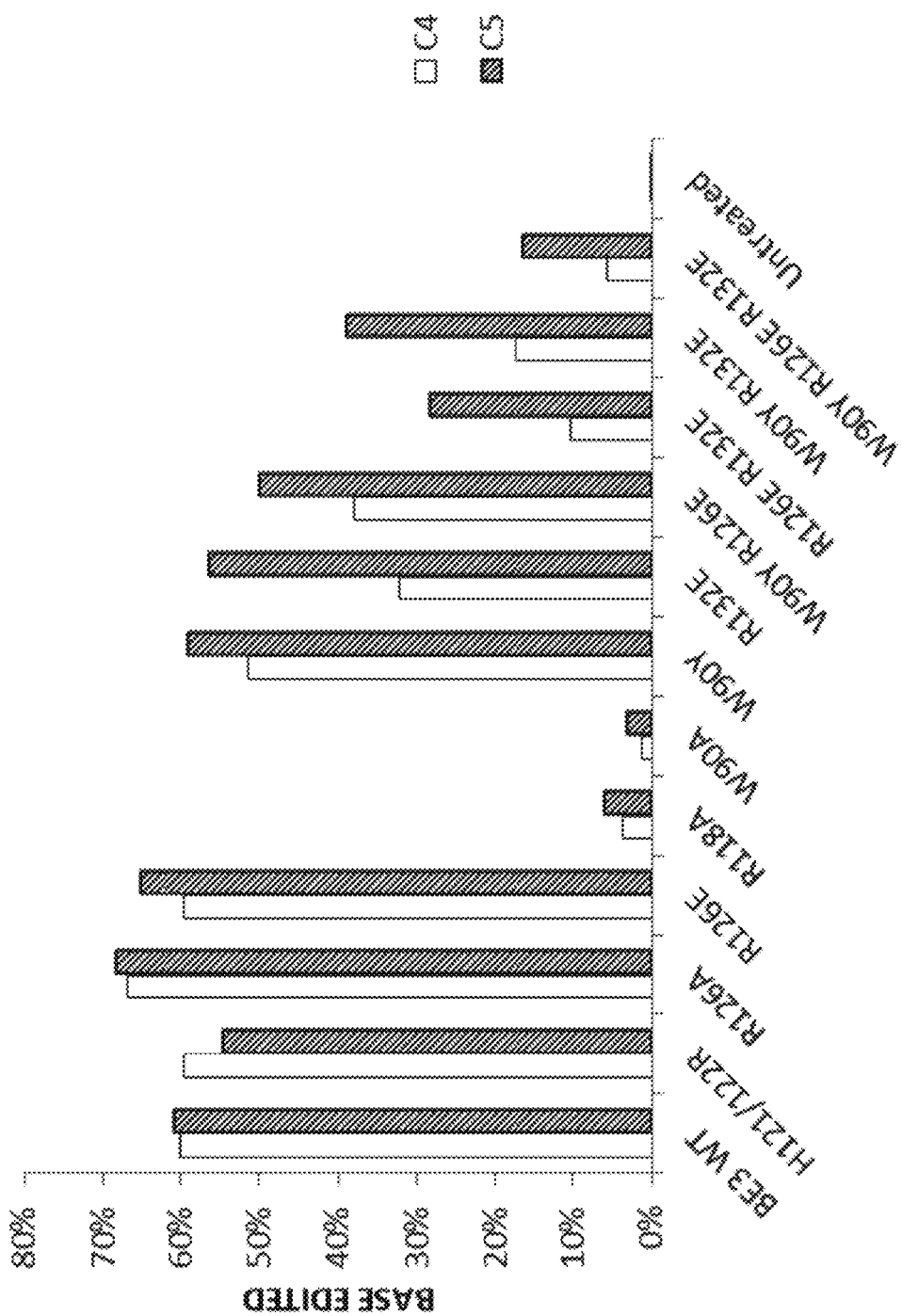

FIG. 69 is a graph showing the effect of various mutations on the HEK3 site with a limited number of cytidines. The spacer used was: GGCC$_4$C$_5$AGACTGAGCACGTGATGG (SEQ ID NO: 310). Note that the double and triple mutants preferentially edit the cytidine at the fifth position over the cytidine in the fourth position.

Figure 70:
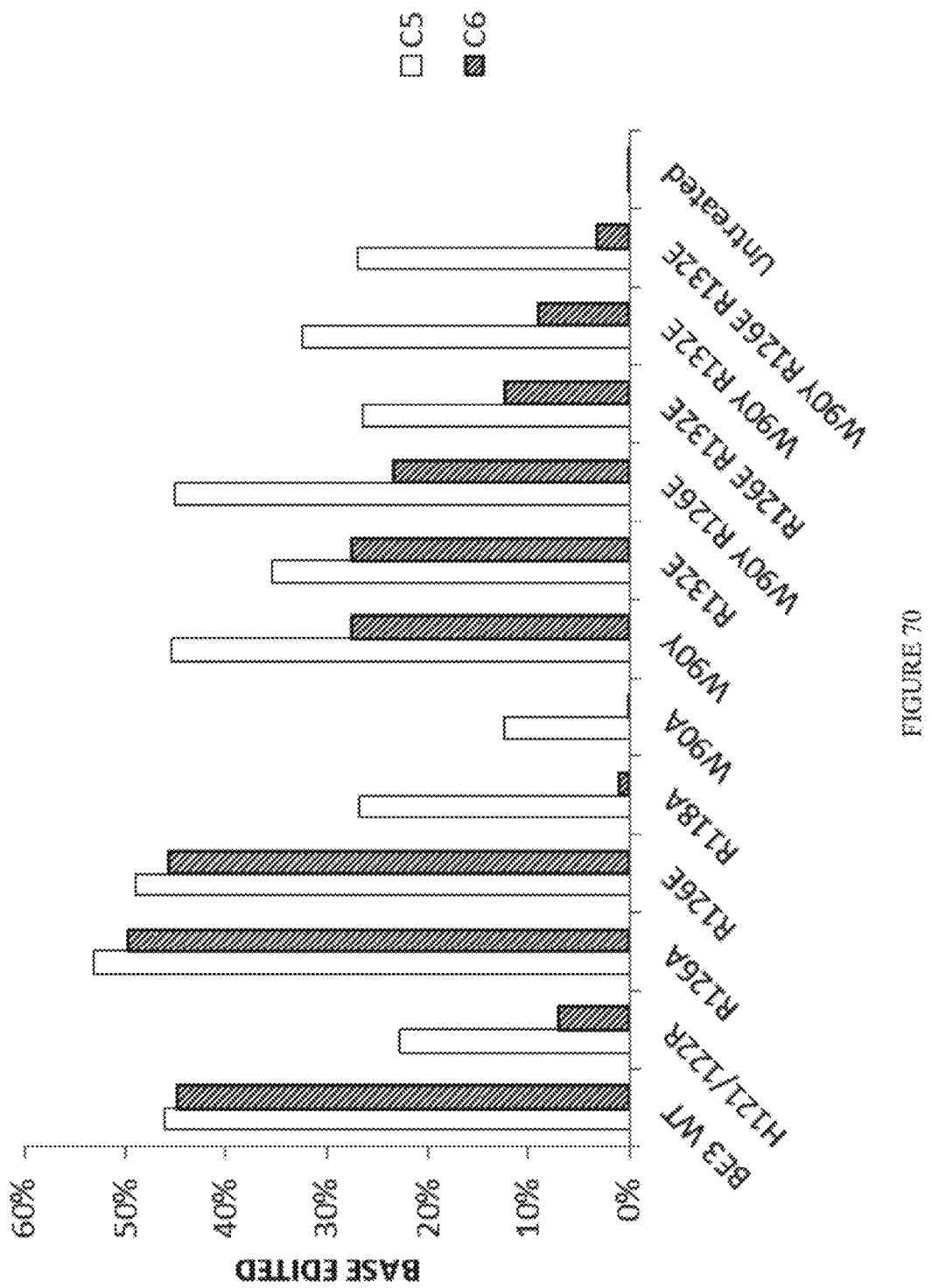

FIG. 70 is a graph showing the effect of various mutations on the EMX1 site with a limited number of cytidines. The spacer used was: GAGTC$_5$C$_6$GAGCAGAAGAAGAAGGG (SEQ ID NO: 311). Note that the triple mutant only edits the cytidine at the fifth position, not the sixth.

Figure 71:
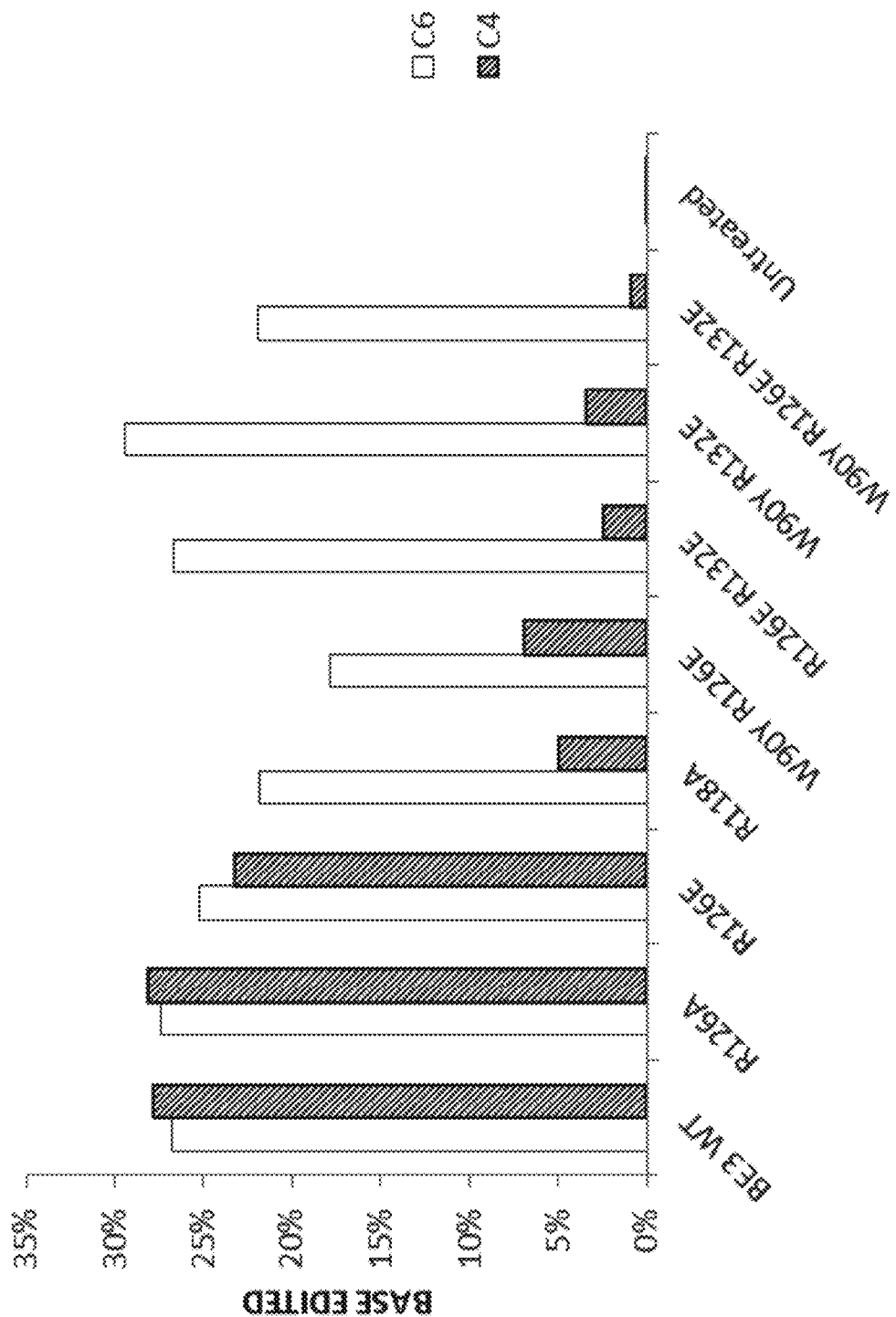

FIG. 71 is a graph showing the effect of various mutations on the HEK2 site with a limited number of cytidines. The spacer used was: GAAC$_4$AC$_6$AAAGCATAGACTGCGGG (SEQ ID NO: 312).

Figure 72:
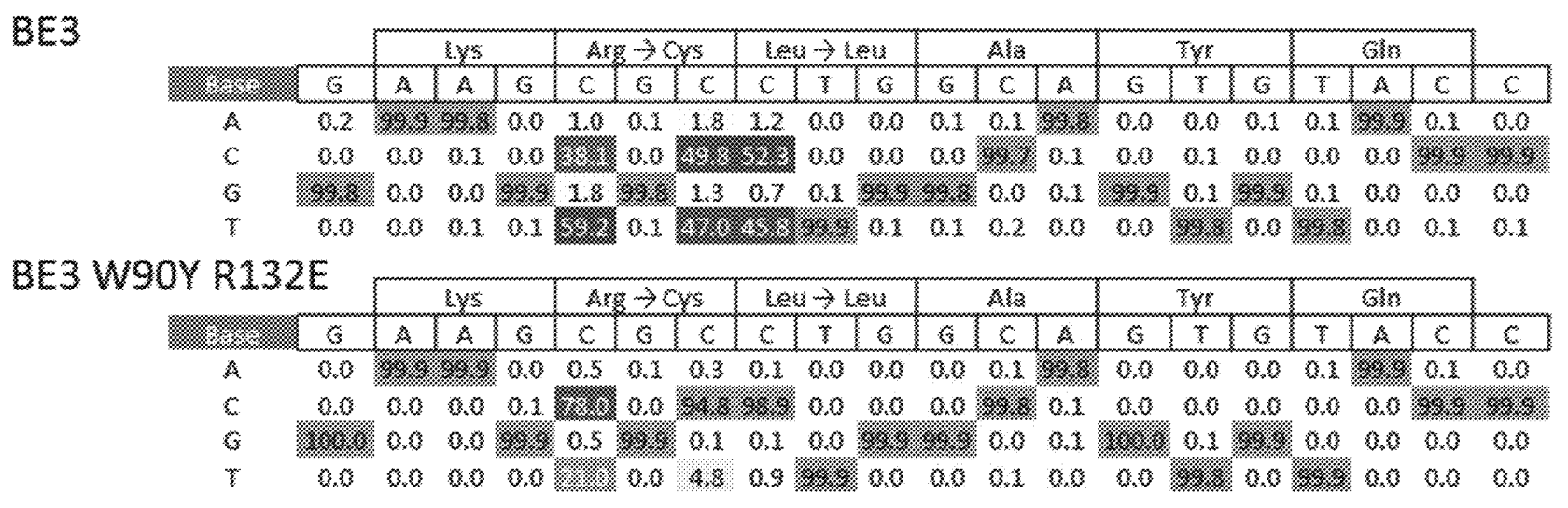

FIG. 72 shows on-target base editing efficiencies of BE3 and BE3 comprising mutations W90Y R132E in immortalized astrocytes. The amino acid sequences correspond to SEQ ID NO: 5789. The nucleic acid sequences correspond to SEQ ID NO: 5790.

Figure 73:
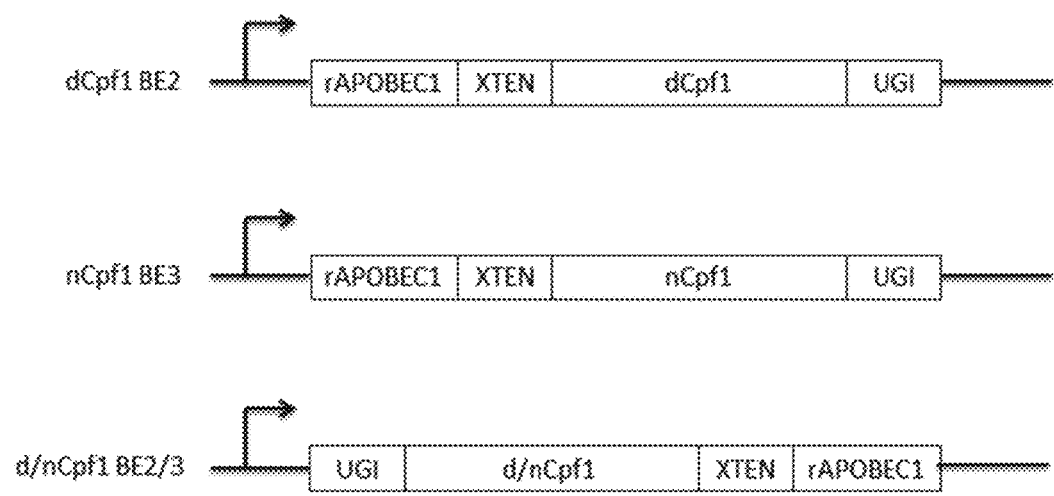

FIG. 73 depicts a schematic of three Cpf1 fusion constructs.

Figure 74:
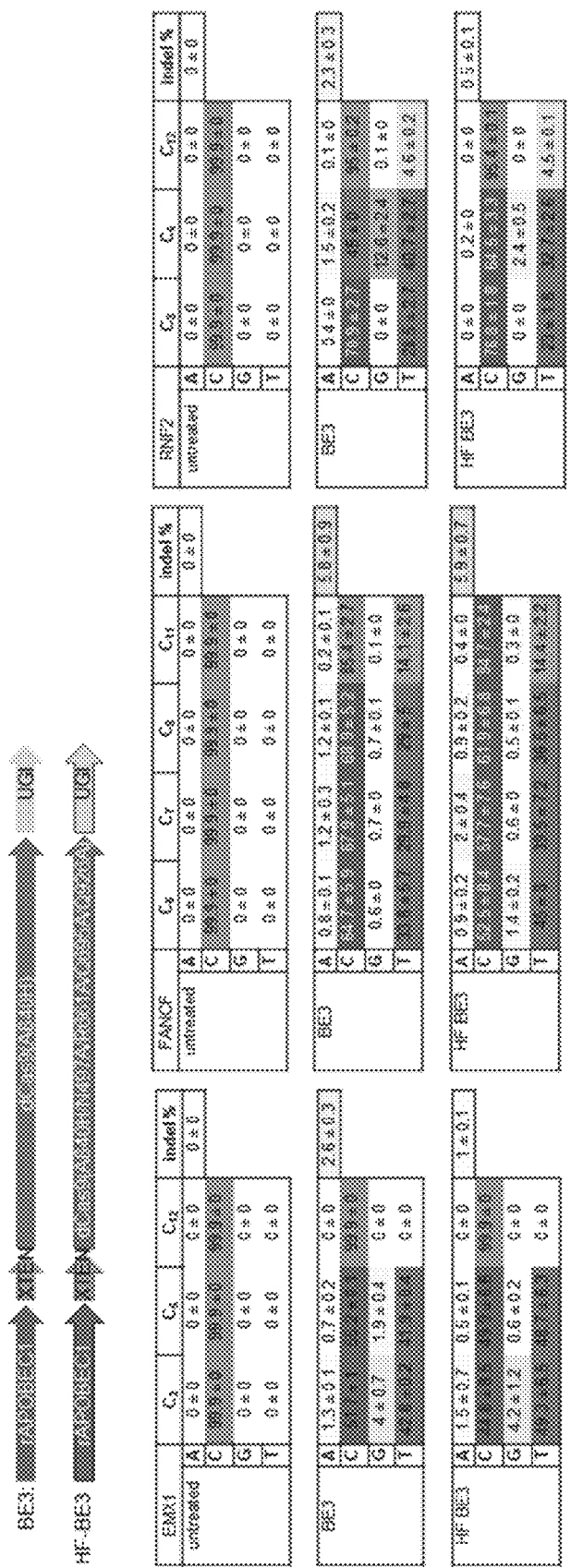

FIG. 74 shows a comparison of plasmid delivery of BE3 and HF-BE3 (EMX1, FANCF, and RNF2).

Figure 75:
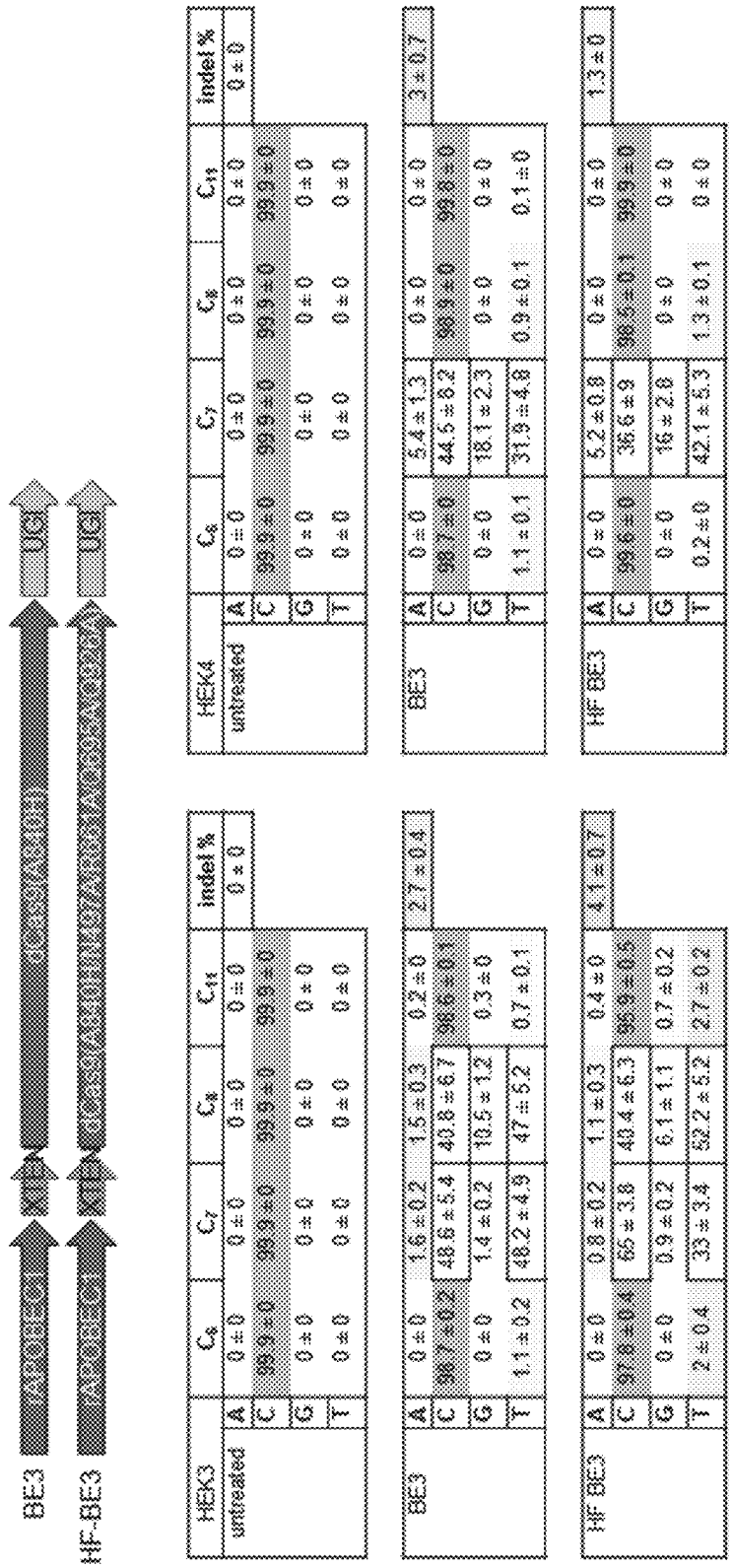

FIG. 75 shows a comparison of plasmid delivery of BE3 and HF-BE3 (HEK3 and HEK 4).

Figure 76:
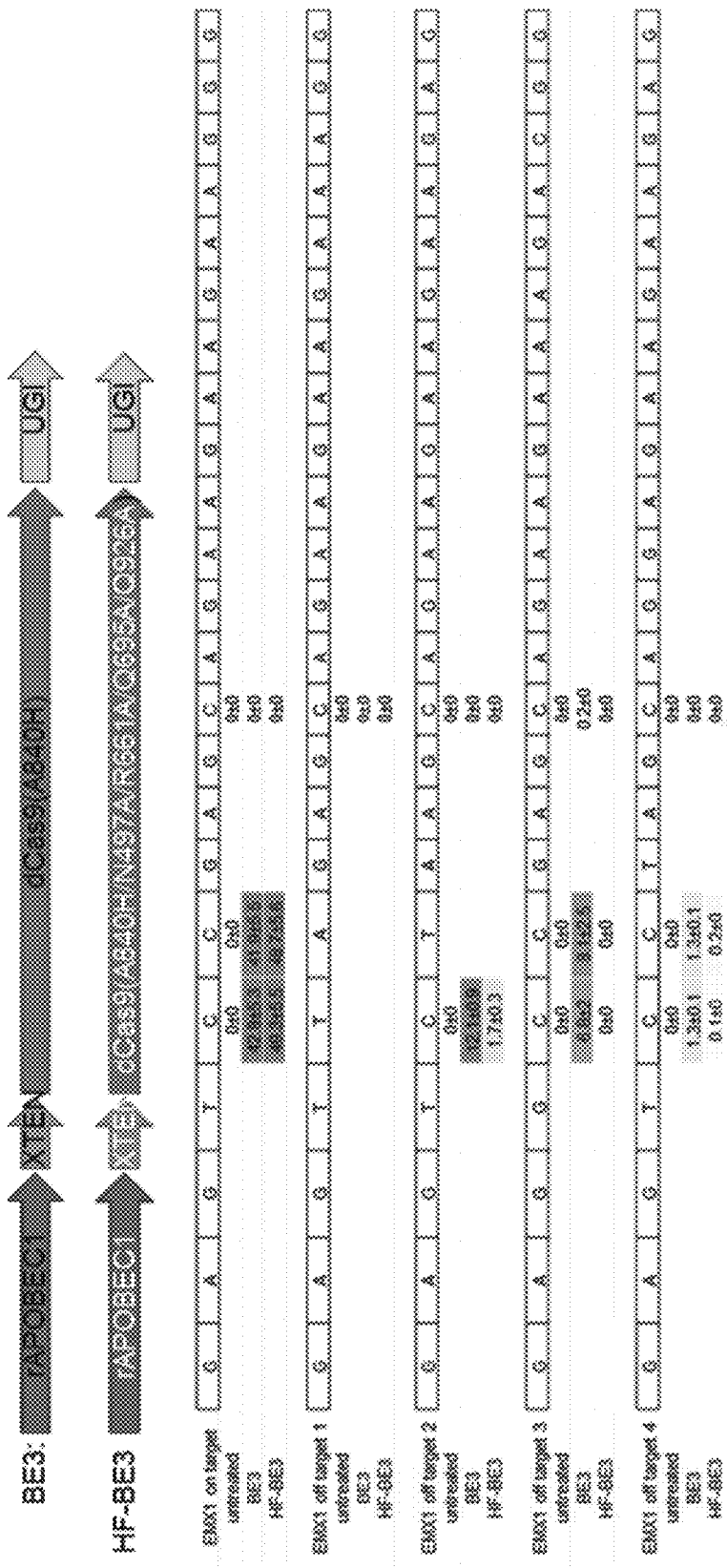

FIG. 76 shows off-target editing of EMX-1 at all 10 sites. This figure depicts SEQ ID NOs: 293 and 5767 through 5775 from top to bottom, respectively.

Figure 77:
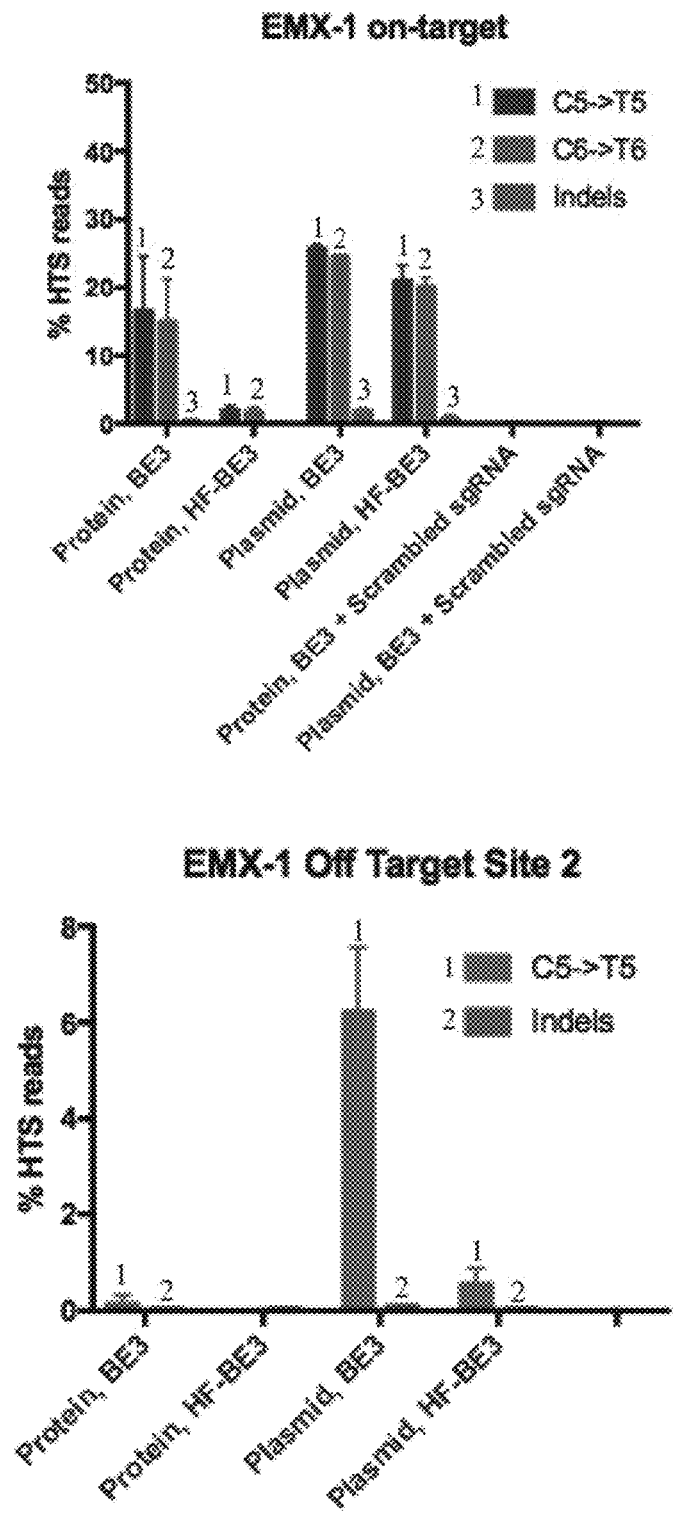

FIG. 77 shows deaminase protein lipofection to HEK cells using a GAGTCCGAGCAGAAGAAGAAG (SEQ ID NO: 313) spacer. The EMX-1 on-target and EMX-1 off target site 2 were examined.

FIG. 78 shows deaminase protein lipofection to HEK cells using a GGAATCCCTTCTGCAGCACCTGG (SEQ ID NO: 314) spacer. The FANCF on target and FANCF off target site 1 were examined.

Figure 79:
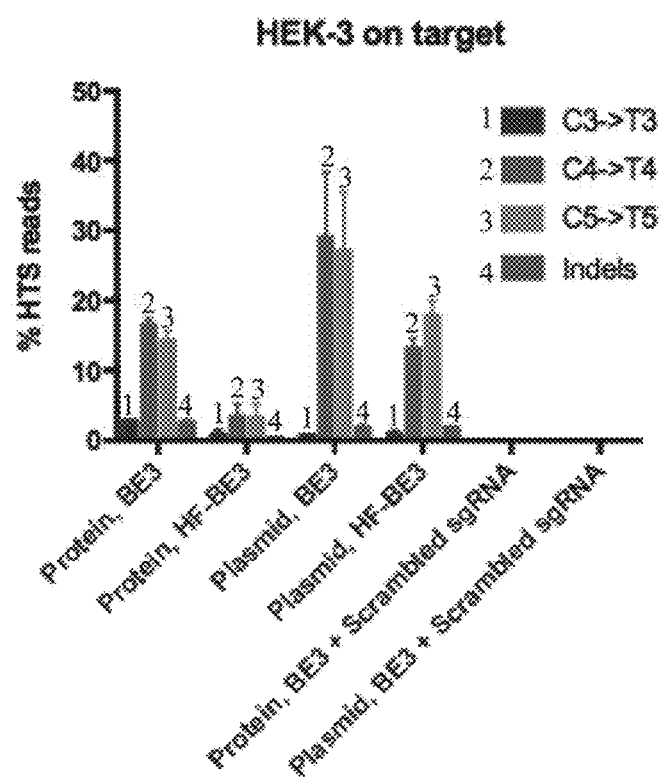

FIG. 79 shows deaminase protein lipofection to HEK cells using a GGCCCAGACTGAGCACGTGA (SEQ ID NO: 315) spacer. The HEK-3 on target site was examined.

Figure 80:
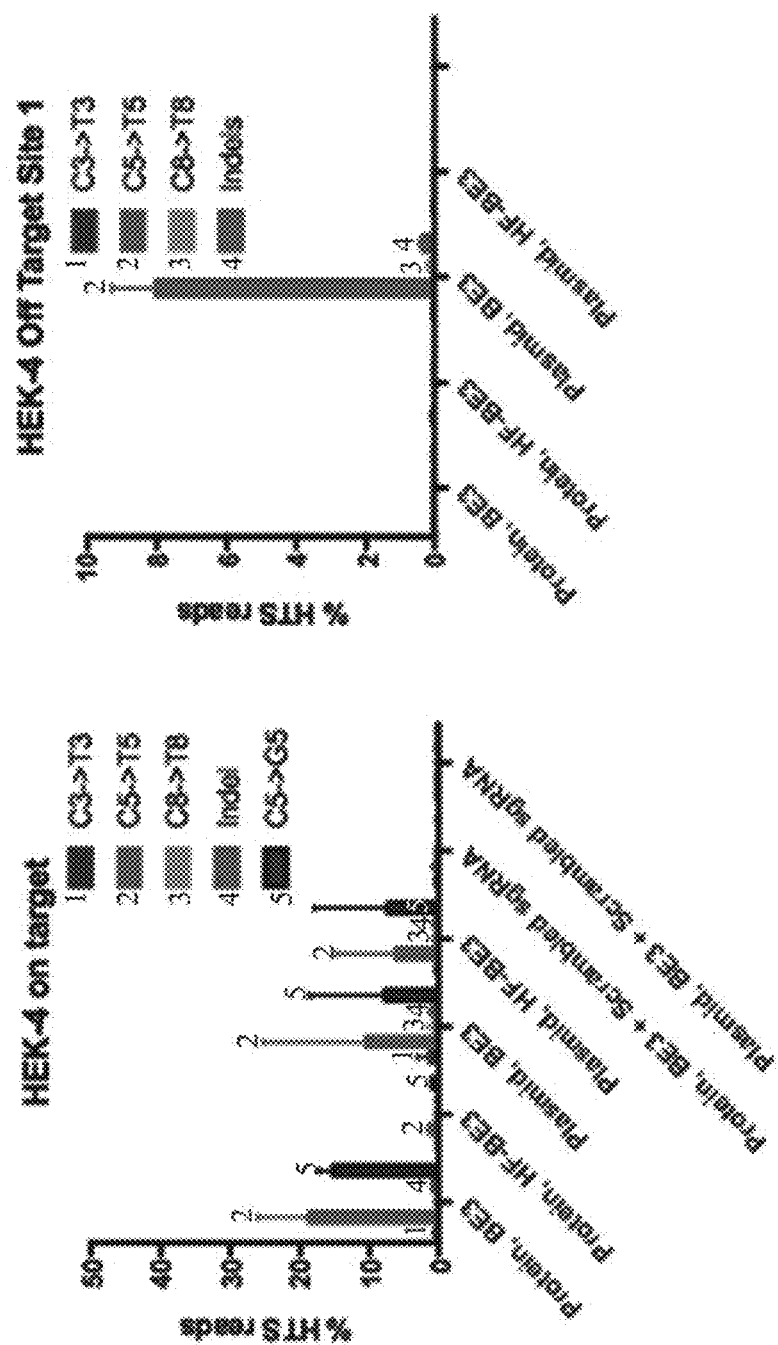
Figure 80:
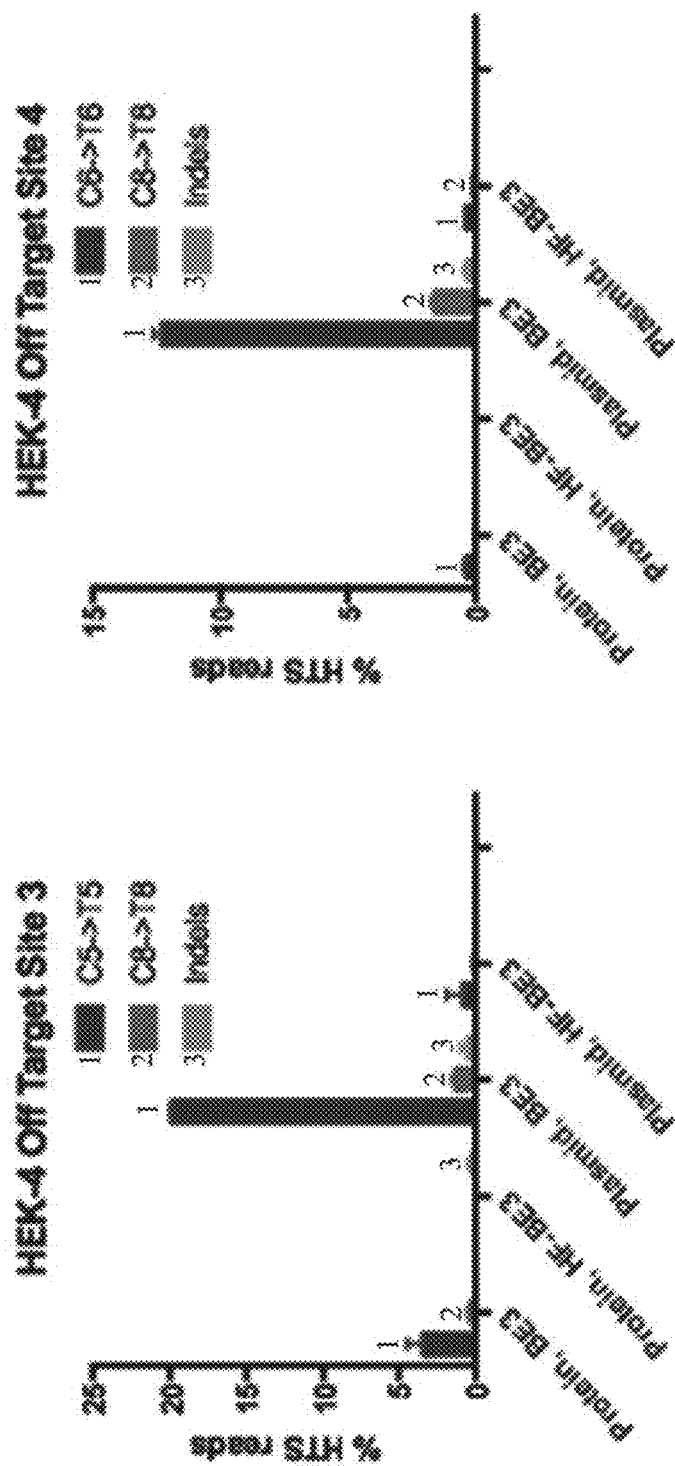

FIG. 80 shows deaminase protein lipofection to HEK cells using a GGCACTGCGGCTGGAGGTGGGGG (SEQ ID NO: 316) spacer. The HEK-4 on target, off target site 1, site 3, and site 4.

Figure 81:
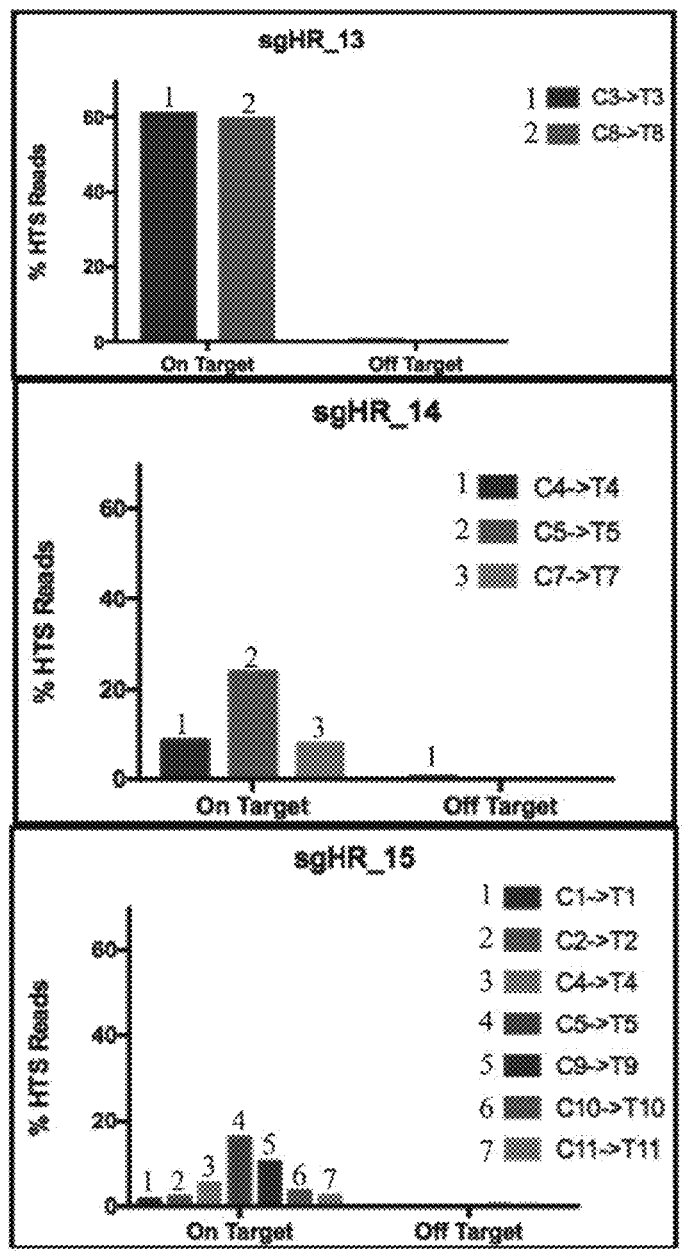

FIG. 81 shows the results of an in vitro assay for sgRNA activity for sgHR_13 (GTCAGGTCGAGGGTTCTGTC (SEQ ID NO: 317) spacer; C8 target: G51 to STOP), sgHR_14 (GGGCCGCAGTATCCTCACTC (SEQ ID NO:

318) spacer; C7 target; C7 target: Q68 to STOP), and sgHR_15 (CCGCCAGTCCCAGTACGGGA (SEQ ID NO: 319) spacer; C10 and C11 are targets: W239 or W237 to STOP).

Figure 82:
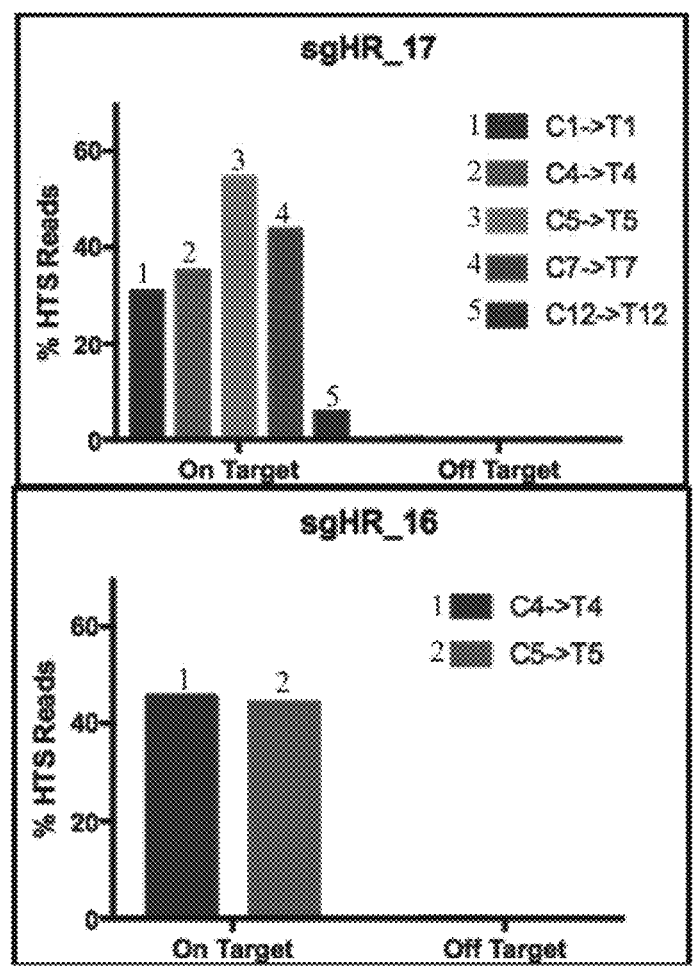

FIG. 82 shows the results of an in vitro assay for sgHR_17 (CAACCACTGCTCAAAGATGC (SEQ ID NO: 320) spacer; C4 and C5 are targets: W410 to STOP), and sgHR_16 (CTTCCAGGATGAGAACACAG (SEQ ID NO: 321) spacer; C4 and C5 are targets: W273 to STOP).

Figure 83:
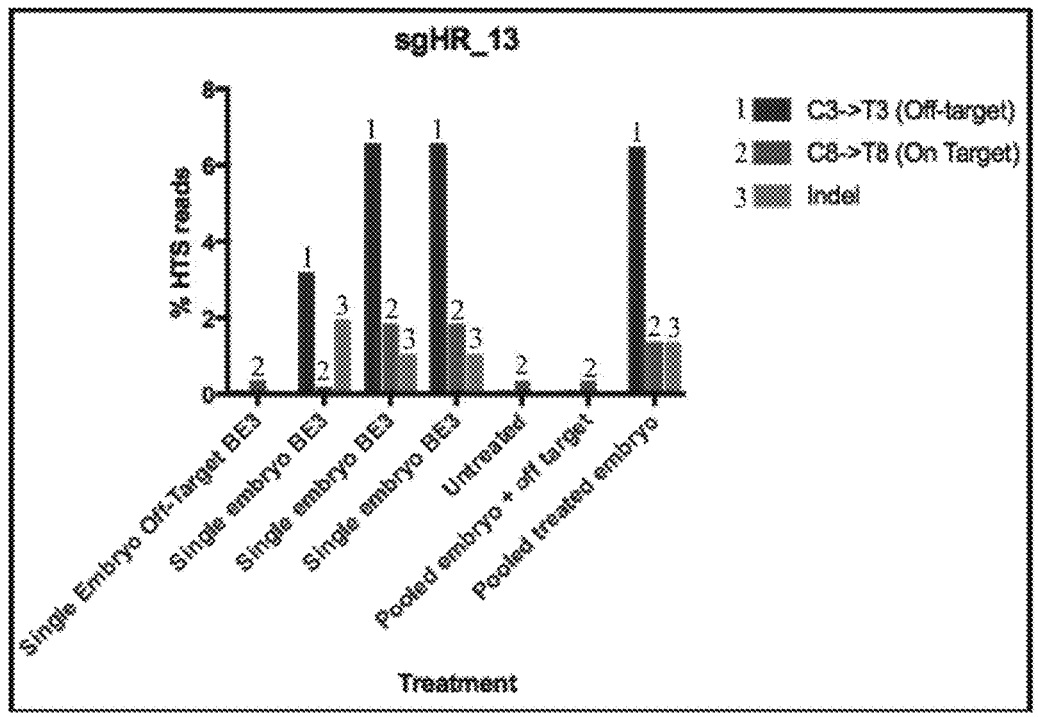

FIG. 83 shows the direct injection of BE3 protein complexed with sgHR_13 in zebrafish embryos.

Figure 84:
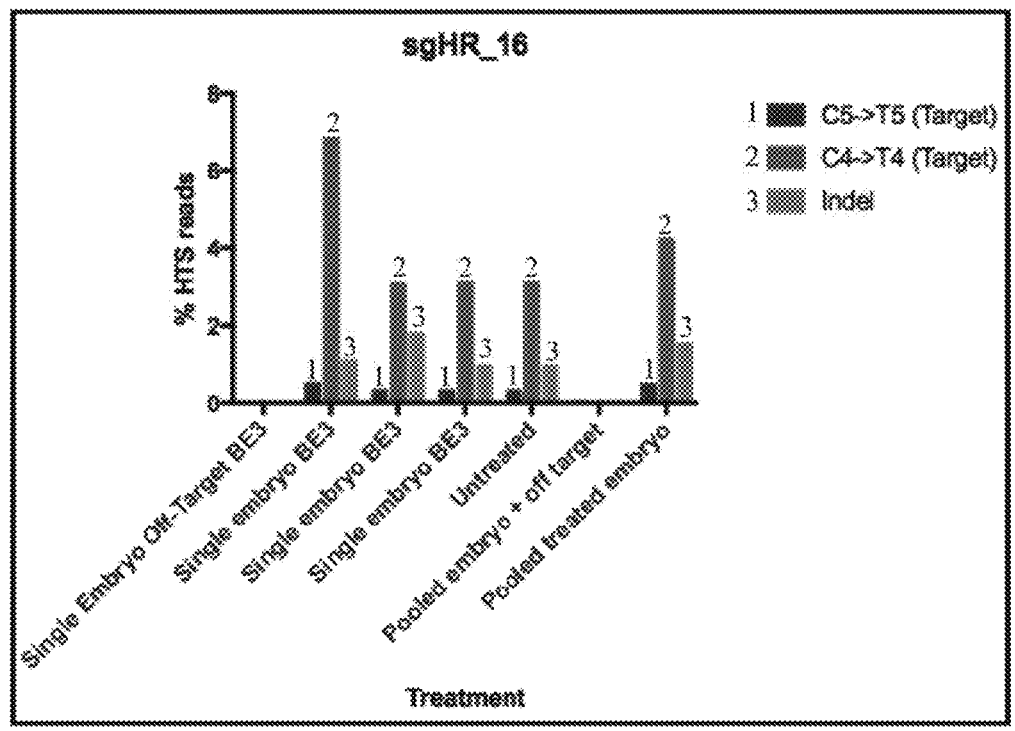

FIG. 84 shows the direct injection of BE3 protein complexed with sgHR_16 in zebrafish embryos.

Figure 85:
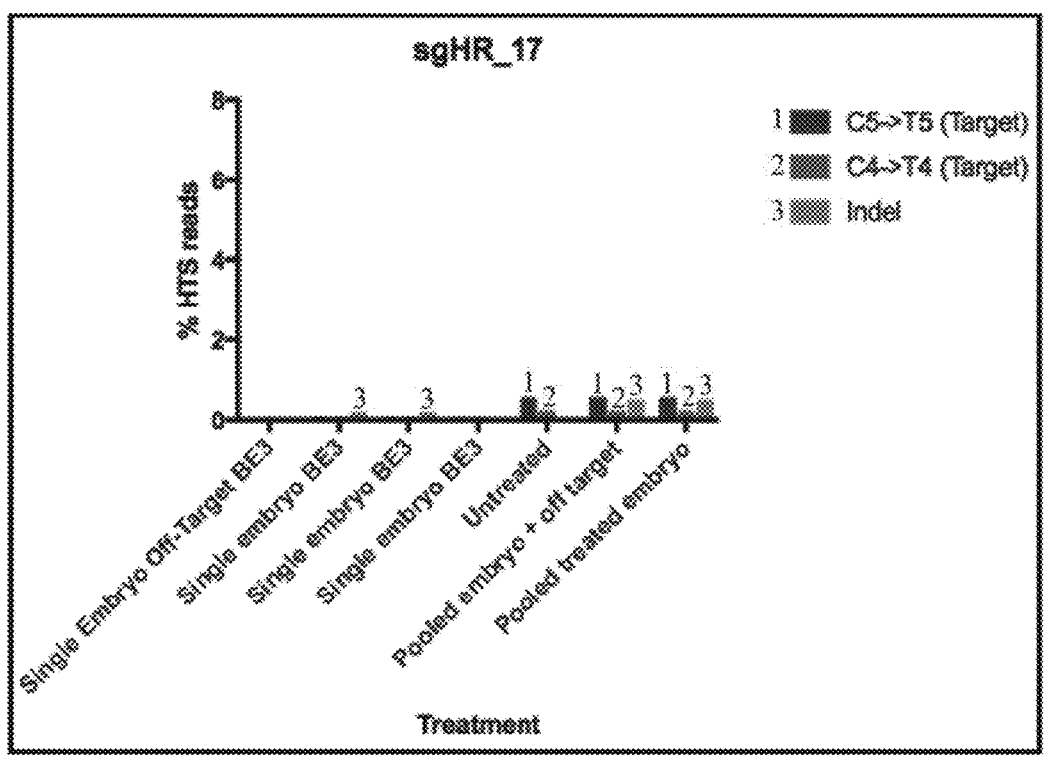

FIG. 85 shows the direct injection of BE3 protein complexed with sgHR_17 in zebrafish embryos.

Figure 86:
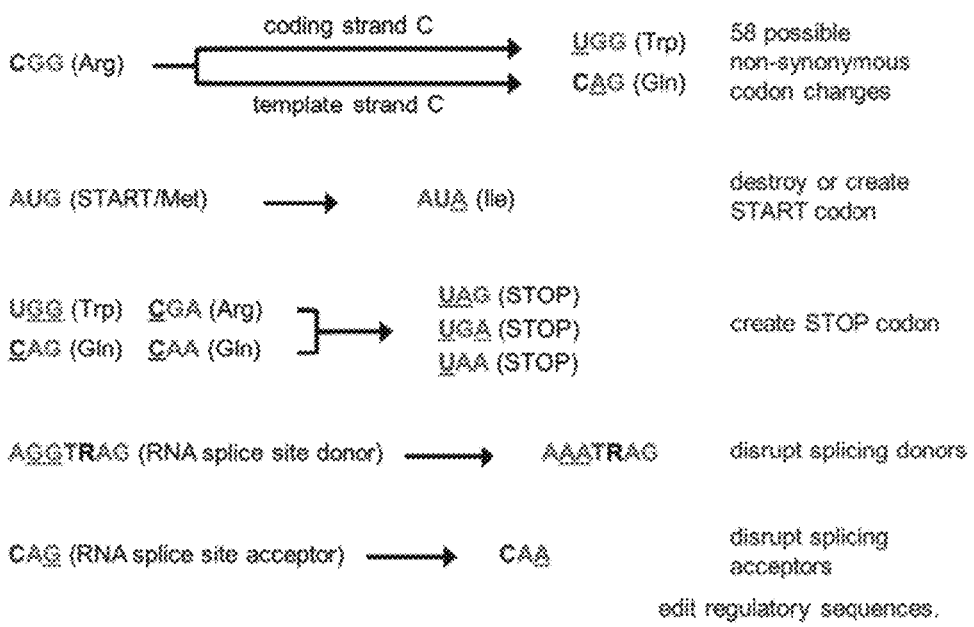

FIG. 86 shows exemplary nucleic acid changes that may be made using base editors that are capable of making a cytosine to thymine change.

Figure 87:
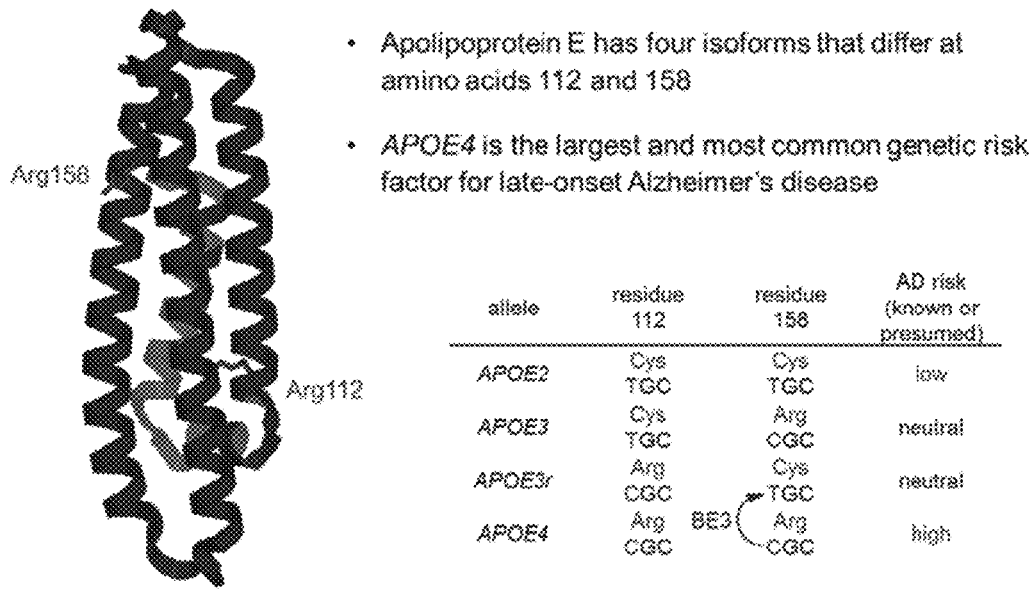

FIG. 87 shows an illustration of apolipoprotein E (APOE) isoforms, demonstrating how a base editor (e.g., BE3) may be used to edit one APOE isoform (e.g., APOE4) into another APOE isoform (e.g., APOE3r) that is associated with a decreased risk of Alzheimer's disease.

Figure 88:
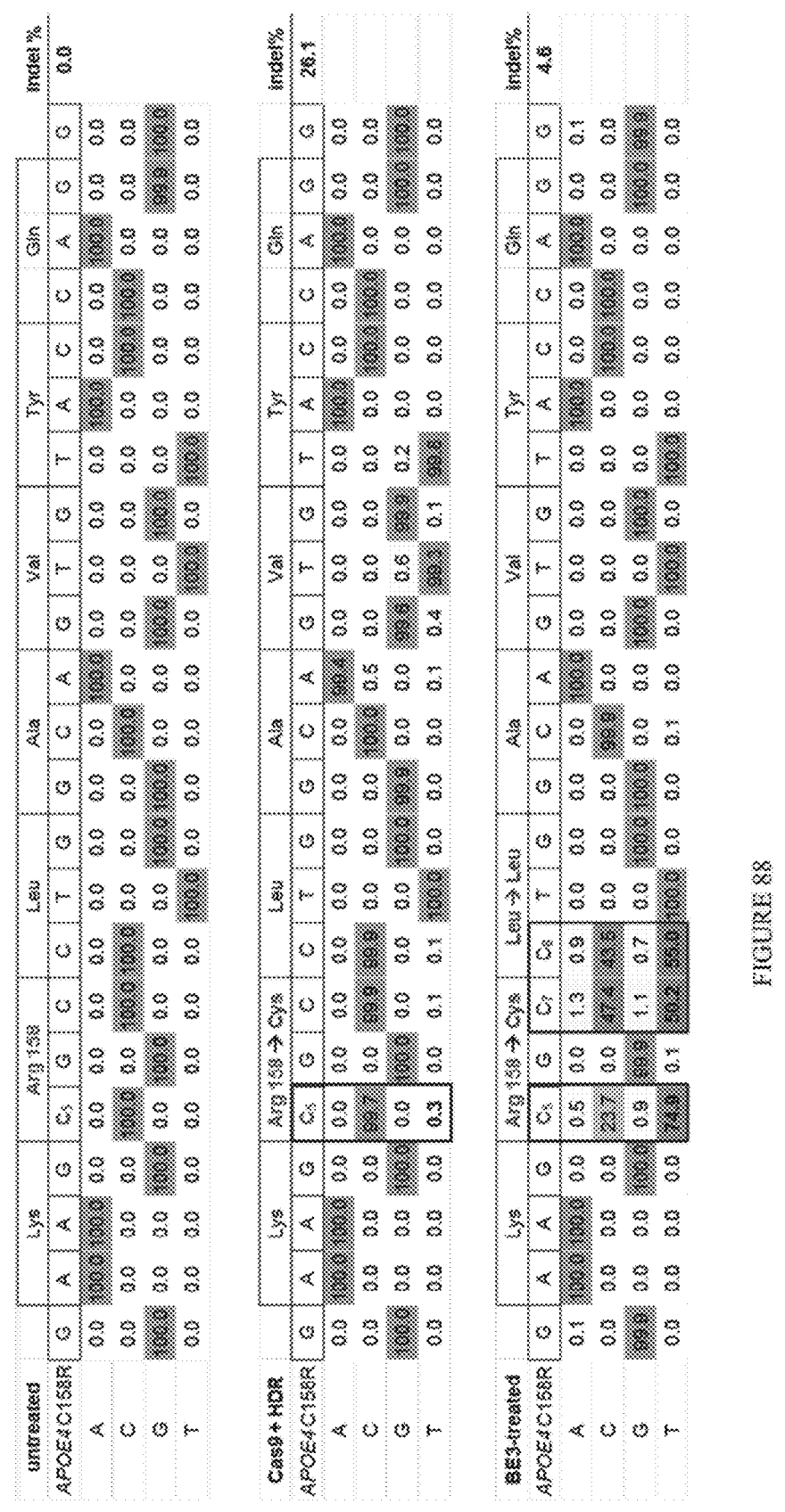

FIG. 88 shows base editing of APOE4 to APOE3r in mouse astrocytes. The amino acid sequences correspond to SEQ ID NOs: 675, 299, and 299 from top to bottom, respectively. The nucleic acid sequences correspond to SEQ ID NO: 5747.

Figure 89:
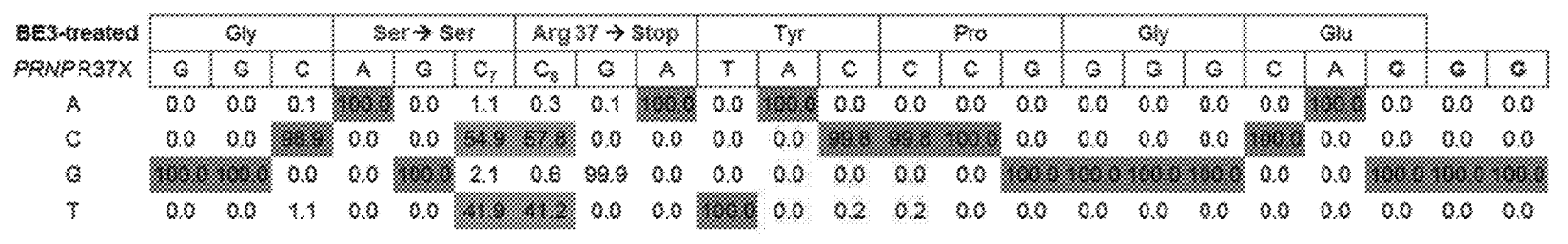

FIG. 89 shows base editing of PRNP to cause early truncation of the protein at arginine residue 37. The sequences correspond to SEQ ID NOs: 5791 (the amino acid sequence) and 4126 (the nucleic acid sequence).

Figure 90:
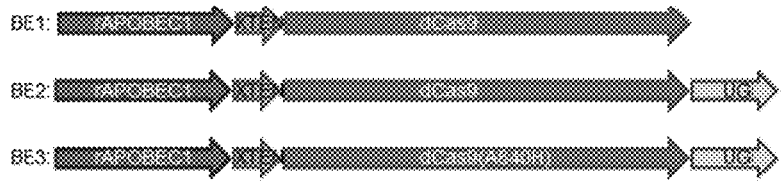

FIG. 90 shows that knocking out UDG (which UGI inhibits) dramatically improves the cleanliness of efficiency of C to T base editing.

FIG. 91 shows that use of a base editor with the nickase but without UGI leads to a mixture of outcomes, with very high indel rates.

Figures 92A, 92B:
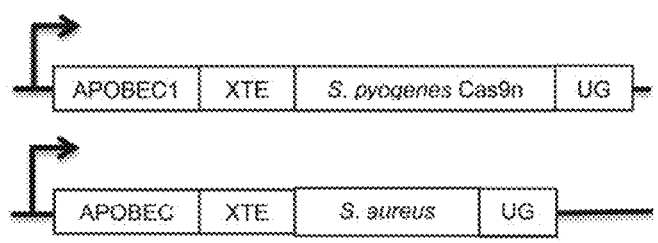
Figure 92C:
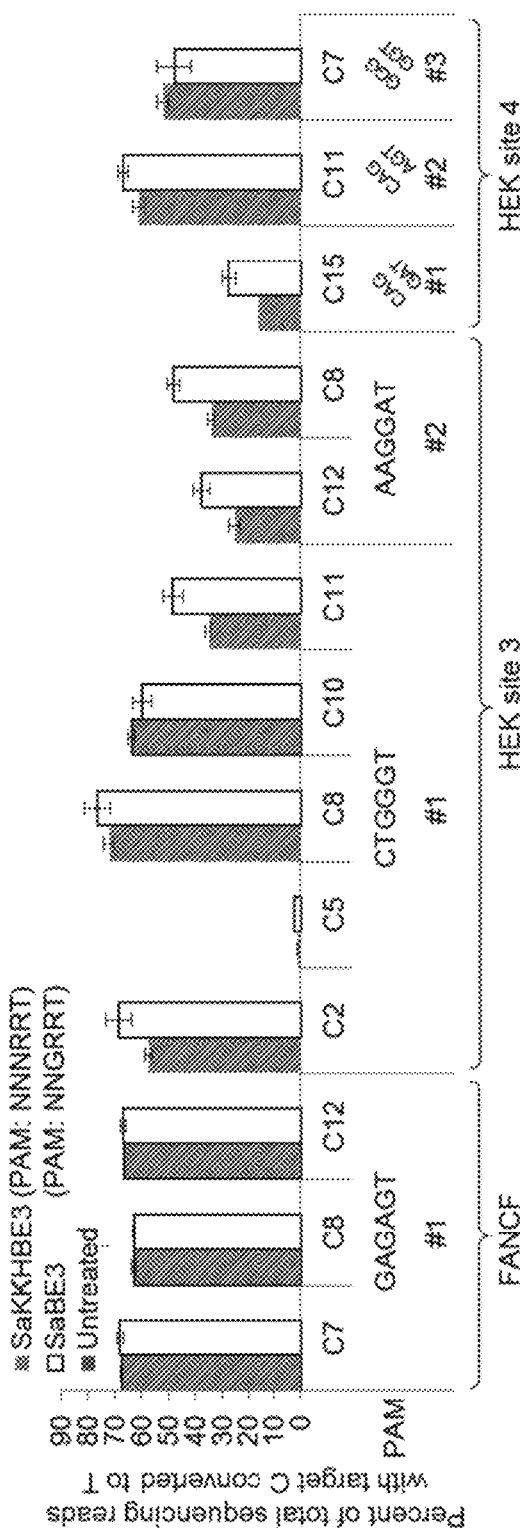
Figure 92D:
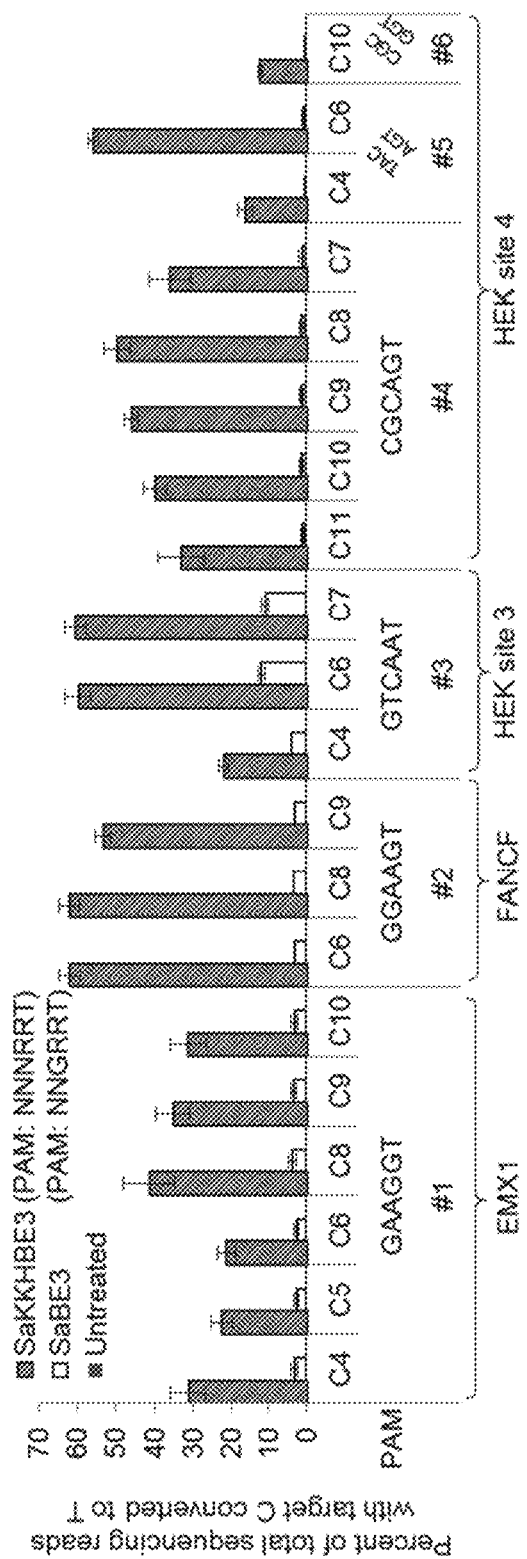
Figure 92E:
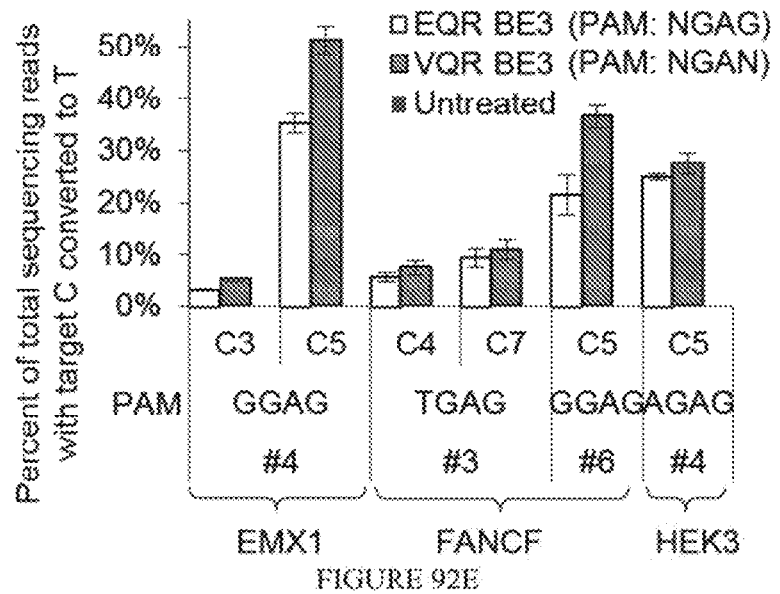
Figure 92F:
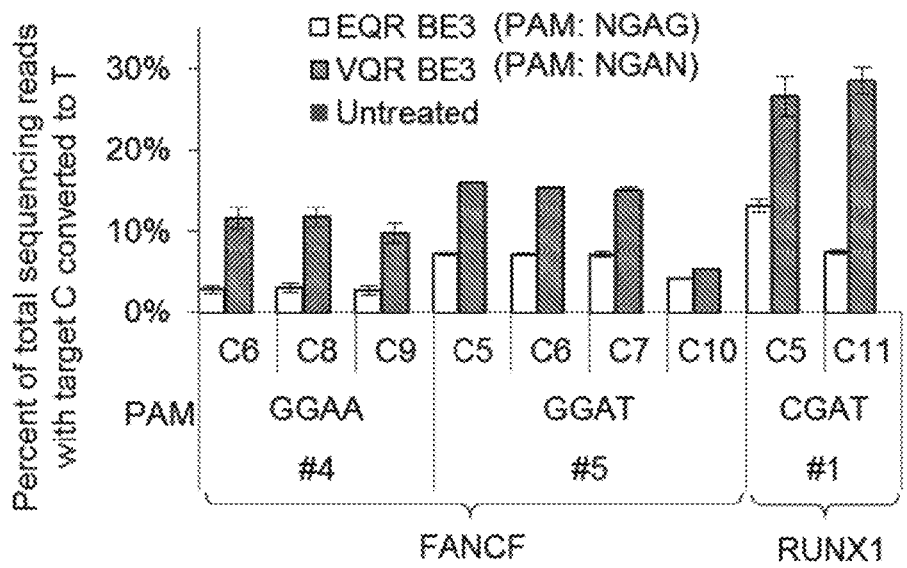
Figure 92G:
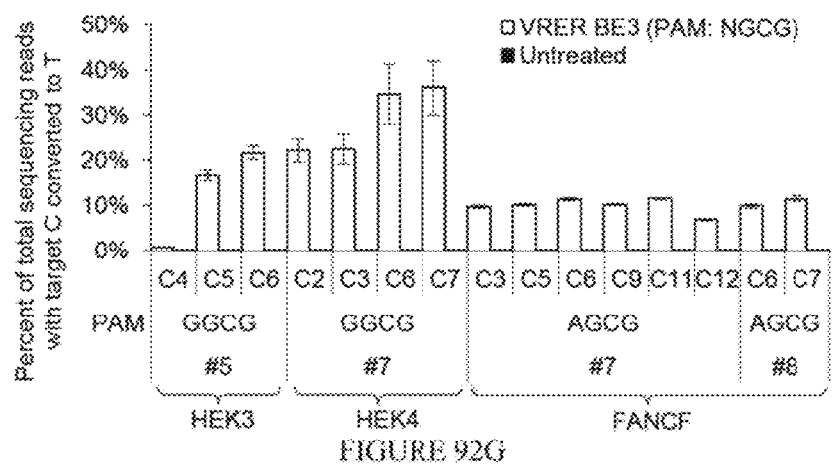

FIGS. 92A to 92G show that SaBE3, SaKKH-BE3, VQR-BE3, EQR-BE3, and VRER-BE3 mediate efficient base editing at target sites containing non-NGG PAMs in human cells. FIG. 92A shows base editor architectures using S. pyogenes and S. aureus Cas9. FIG. 92B shows recently characterized Cas9 variants with alternate or relaxed PAM requirements. FIGS. 92C and 92D show HEK293T cells treated with the base editor variants shown as described in Example 12. The percentage of total DNA sequencing reads (with no enrichment for transfected cells) with C converted to T at the target positions indicated are shown. The PAM sequence of each target tested is shown below the X-axis. The charts show the results for SaBE3 and SaKKH-BE3 at genomic loci with NNGRRT PAMs (FIG. 92C), SaBE3 and SaKKH-BE3 at genomic loci with NNNRRT PAMs (FIG. 92D), VQR-BE3 and EQR-BE3 at genomic loci with NGAG PAMs (FIG. 92E), and with NGAH PAMs (FIG. 92F), and VRER-BE3 at genomic loci with NGCG PAMs (FIG. 92G). Values and error bars reflect the mean and standard deviation of at least two biological replicates.

Figure 93A:
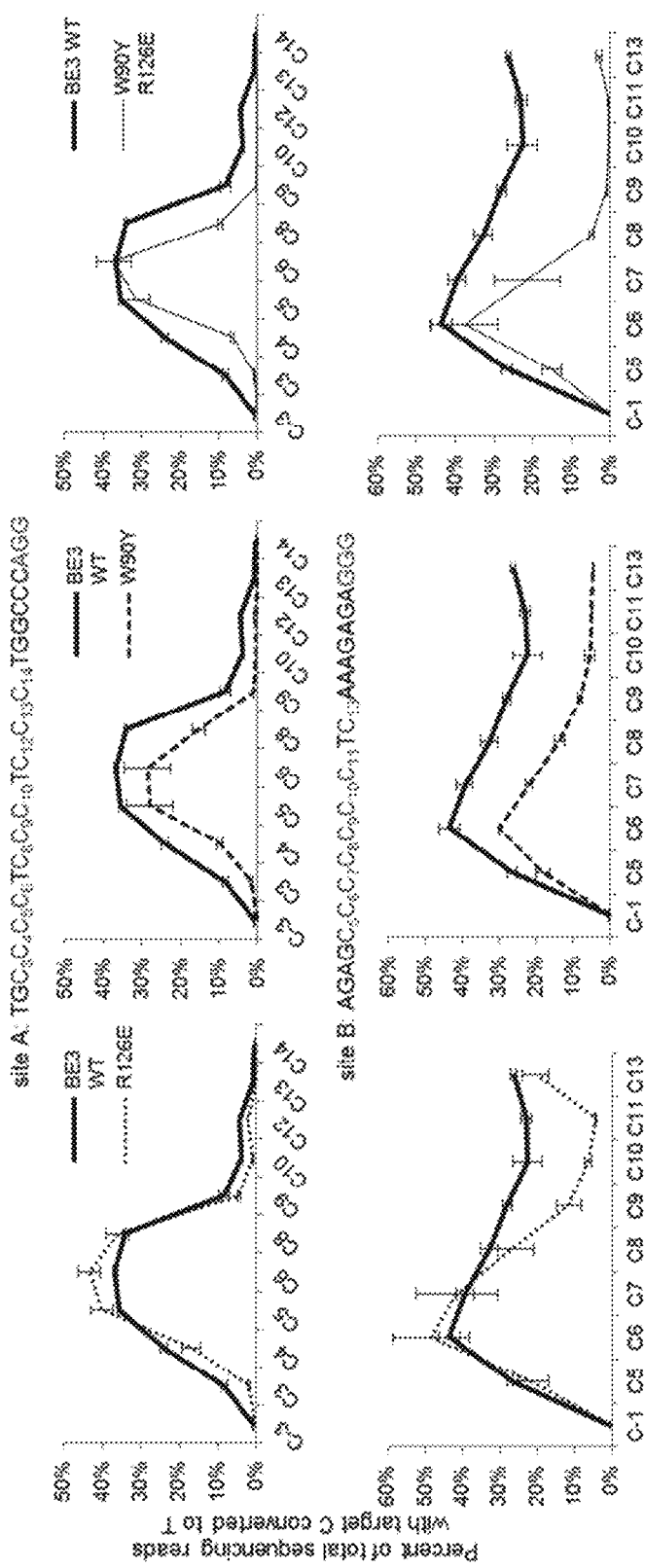
Figure 93B:
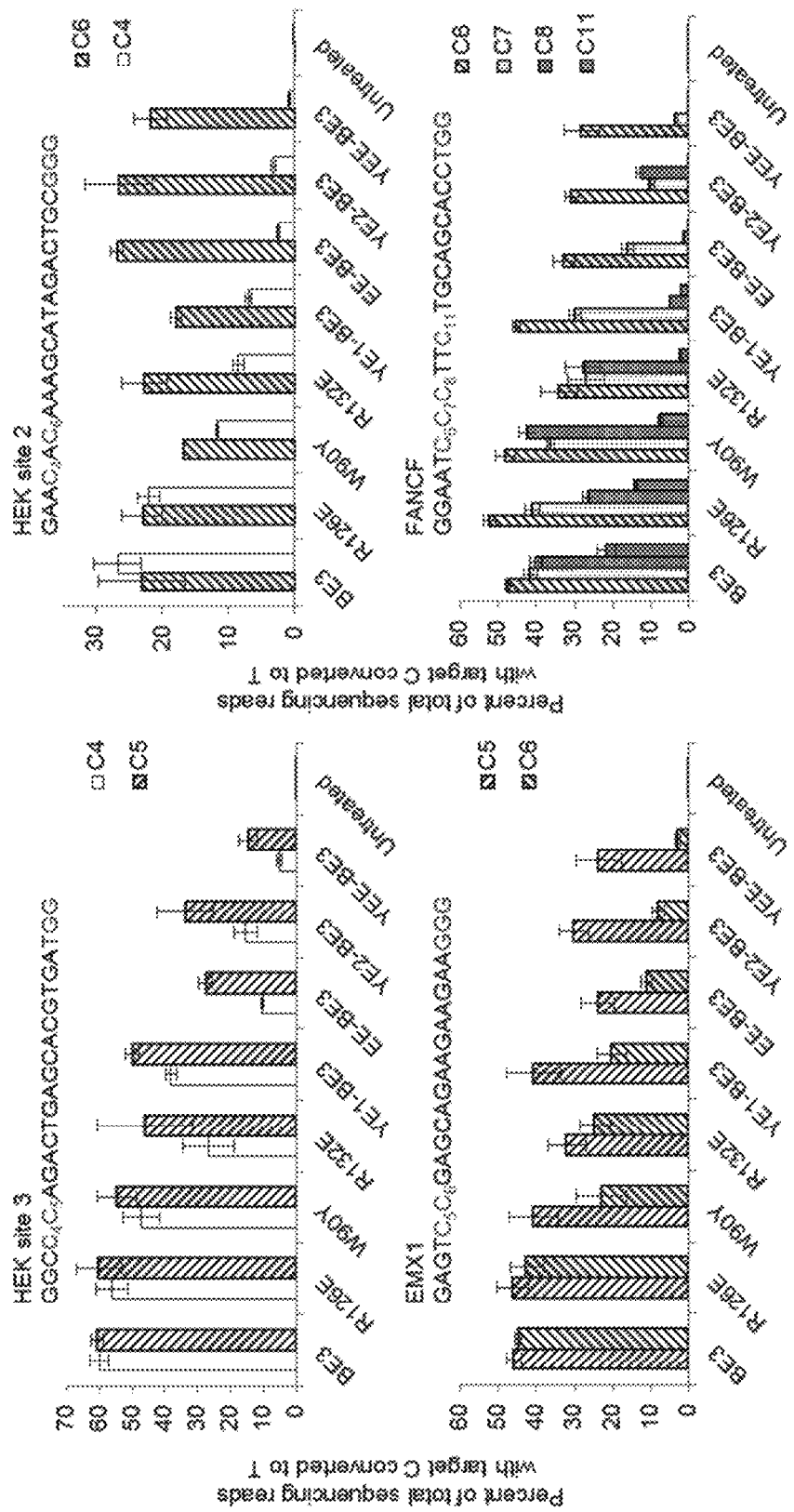
Figure 93C:
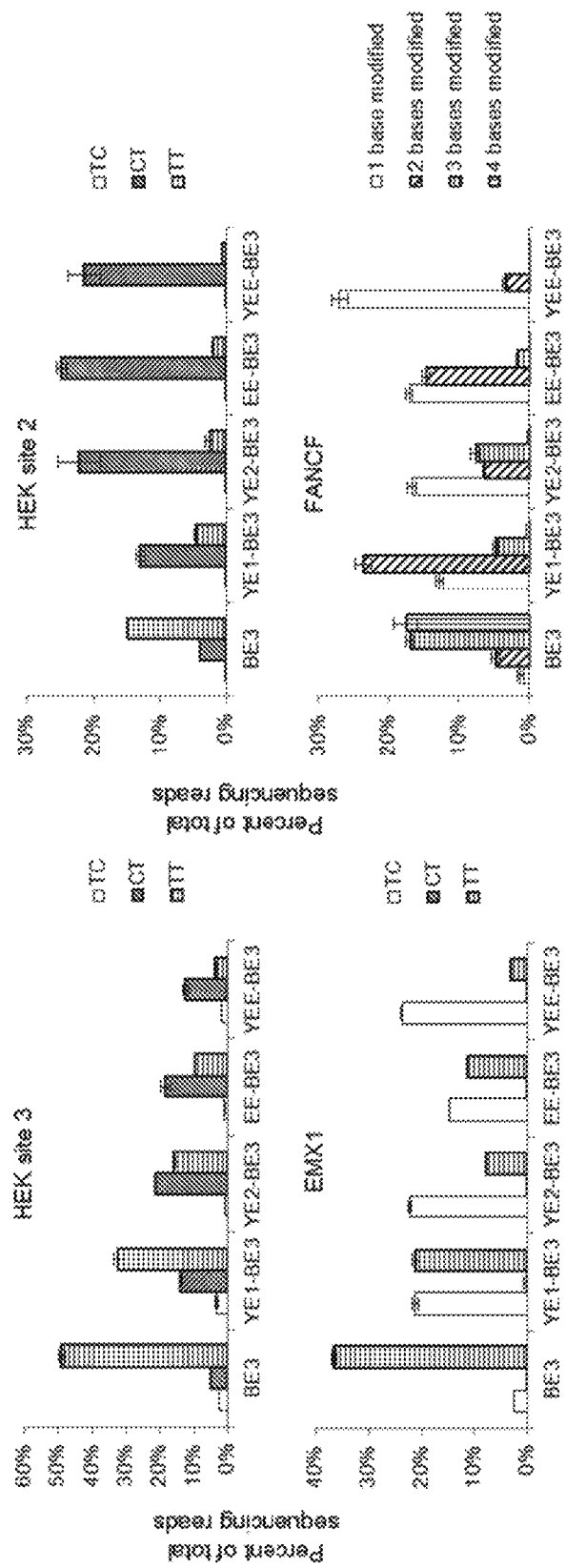

FIGS. 93A to 93C demonstrate that base editors with mutations in the cytidine deaminase domain exhibit narrowed editing windows. FIGS. 93A to 93C show HEK293T cells transfected with plasmids expressing mutant base editors and an appropriate sgRNA. Three days after transfection, genomic DNA was extracted and analyzed by high-throughput DNA sequencing at the indicated loci. The percentage of total DNA sequencing reads (without enrichment for transfected cells) with C changed to T at the target positions indicated are shown for the EMX1 site, HEK293 site 3, FANCF site, HEK293 site 2, site A, and site B loci. FIG. 93A illustrates certain cytidine deaminase mutations which narrow the base editing window. The sequences in FIG. 93A correspond to SEQ ID NOs: 5792 and 5793 from top to bottom, respectively. See FIG. 98 for the characterization of additional mutations. FIG. 93B shows the effect of cytidine deaminase mutations which effect the editing window width on genomic loci. Combining beneficial mutations has an additive effect on narrowing the editing window. The sequences correspond to SEQ ID NOs: 296, 295, 293, and 294 from left to right and top to bottom, respectively. FIG. 93C shows that YE1-BE3, YE2-BE3, EE-BE3, and YEE-BE3 effect the product distribution of base editing, producing predominantly singly-modified products in contrast with BE3. Values and error bars reflect the mean and standard deviation of at least two biological replicates.

Figure 94A:
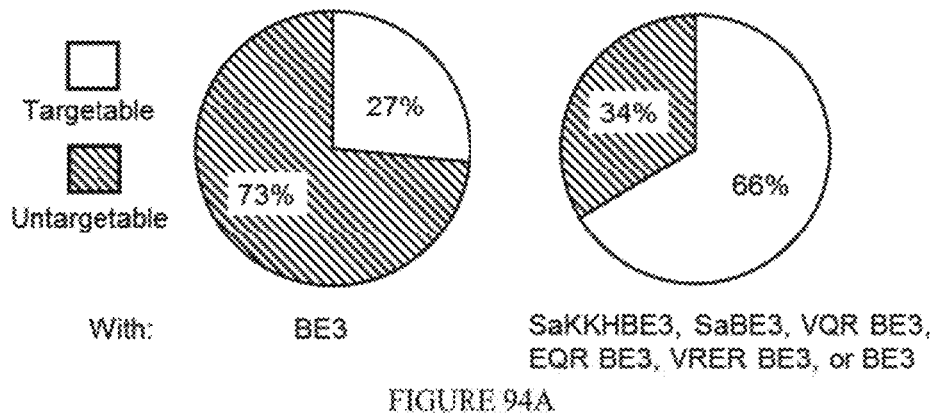
Figure 94B:
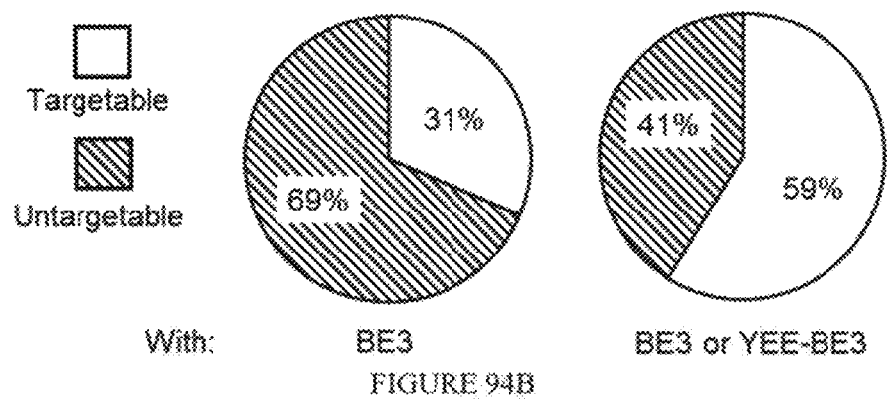

FIGS. 94A and 94B show genetic variants from ClinVar that in principle can be corrected by the base editors developed in this work. The NCBI ClinVar database of human genetic variations and their corresponding phenotypes was searched for genetic diseases that in theory can be corrected by base editing. FIG. 94A demonstrates improvement in base editing targeting scope among all pathogenic T→C mutations in the ClinVar database through the use of base editors with altered PAM specificities. The white fractions denote the proportion of pathogenic T→C mutations accessible on the basis of the PAM requirements of either BE3, or BE3 together with the five modified-PAM base editors developed in this work. FIG. 94B shows improvement in base editing targeting scope among all pathogenic T→C mutations in the ClinVar database through the use of base editors with narrowed activity windows. BE3 was assumed to edit Cs in positions 4-8 with comparable efficiency as shown in FIGS. 93A to 93C. YEE-BE3 was assumed to edit with C5>C6>C7>others preference within its activity window. The white fractions denote the proportion of pathogenic T→C mutations that can be edited BE3 without comparable editing of other Cs (left), or that can be edited BE3 or YEE-BE3 without comparable editing of other Cs (right).

Figure 95A:
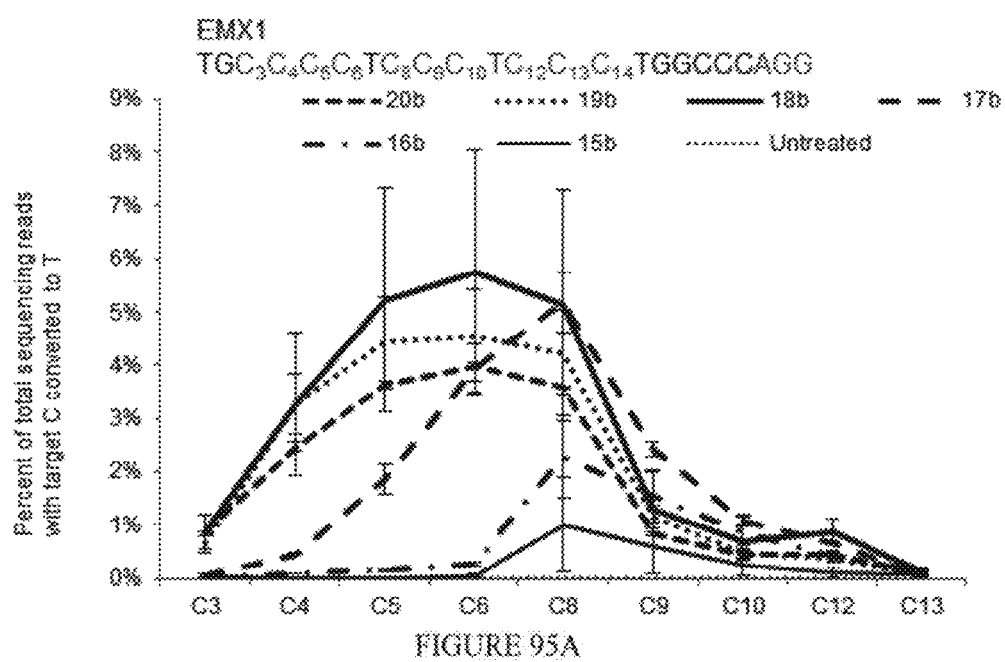
Figure 95B:
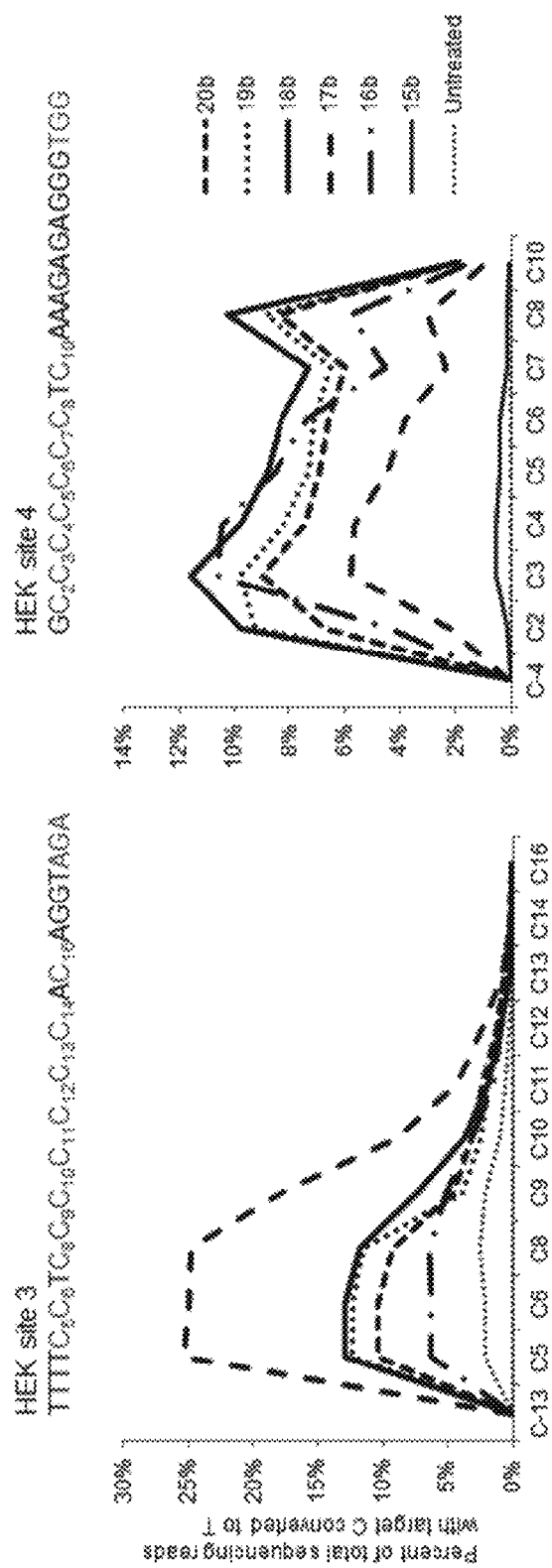

FIGS. 95A to 95B show the effect of truncated guide RNAs on base editing window width. HEK293T cells were transfected with plasmids expressing BE3 and sgRNAs of different 5' truncation lengths. The treated cells were analyzed as described in the Examples. FIG. 95A shows protospacer and PAM sequence (top, SEQ ID NO: 5792) and cellular C to T conversion percentages, defined as the percentage of total DNA sequencing reads with Ts at the target positions indicated, at a site within the EMX1 genomic locus. At this site, the base editing window was altered through the use of a 17-nt truncated gRNA. FIG. 95B shows protospacer and PAM sequences (top, SEQ ID NOs: 5794 and 5795 from left to right, respectively) and cellular C to T conversion percentages, defined as the percentage of total DNA sequencing reads with Ts at the target positions indicated, at sites within the HEK site 3 and site 4 genomic loci. At these sites, no change in the base editing window was observed, but a linear decrease in editing efficiency for all substrate bases as the sgRNA is truncated was noted.

FIG. 96 shows the effect of APOBEC1-Cas9 linker lengths on base editing window width. HEK293T cells were transfected with plasmids expressing base editors with rAPOBEC1-Cas9 linkers of XTEN, GGS, (GGS)$_3$ (SEQ ID NO: 596), (GGS)$_5$ (SEQ ID NO: 4271), or (GGS)$_7$ (SEQ ID NO: 597) and an sgRNA. The treated cells were analyzed as described in the Examples. Cellular C to T conversion percentages, defined as the percentage of total DNA sequencing reads with Ts at the target positions indicated, are shown for the various base editors with different linkers. The sequence corresponds to SEQ ID NO: 5792.

Figure 97C:
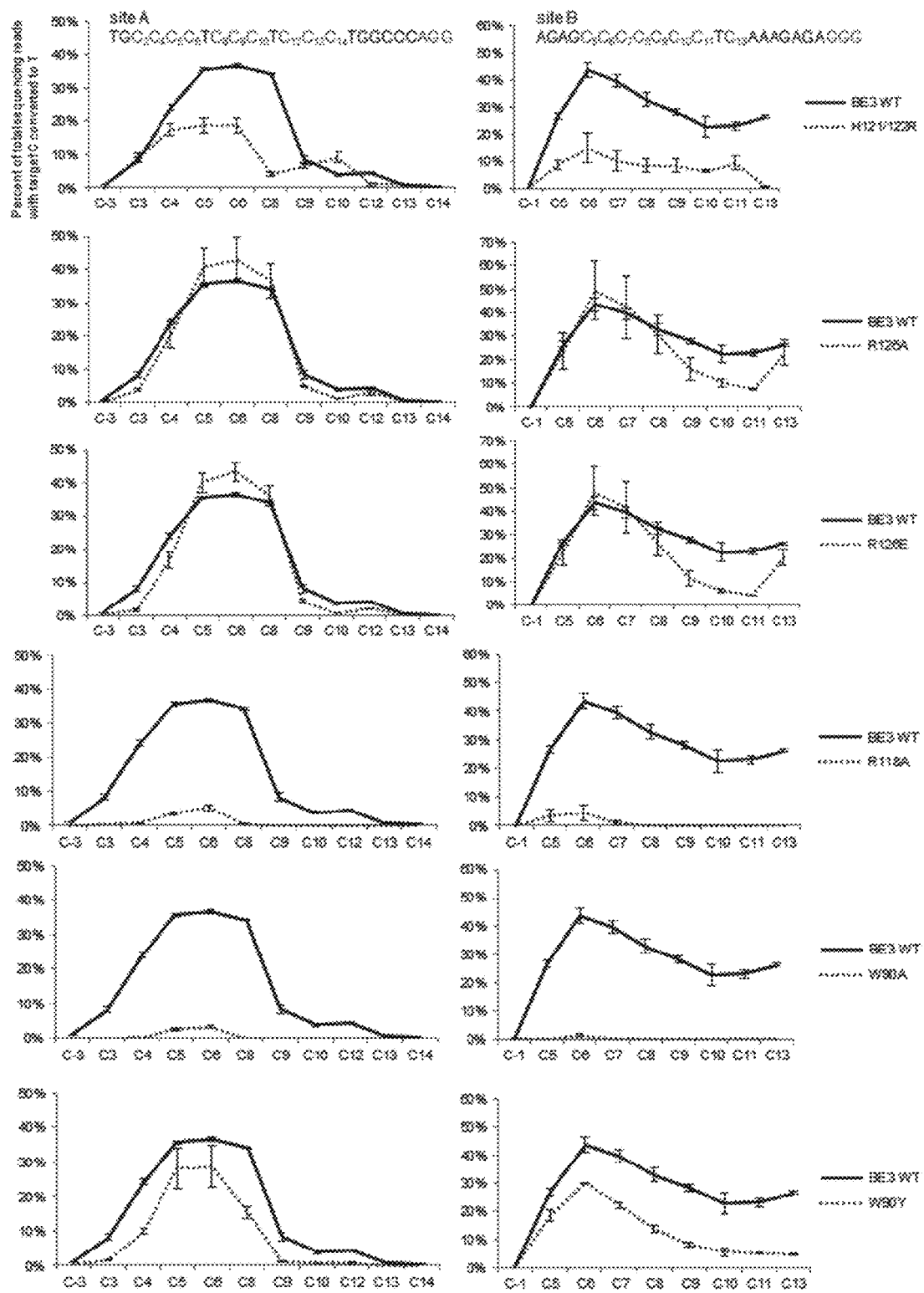
Figure 97C:
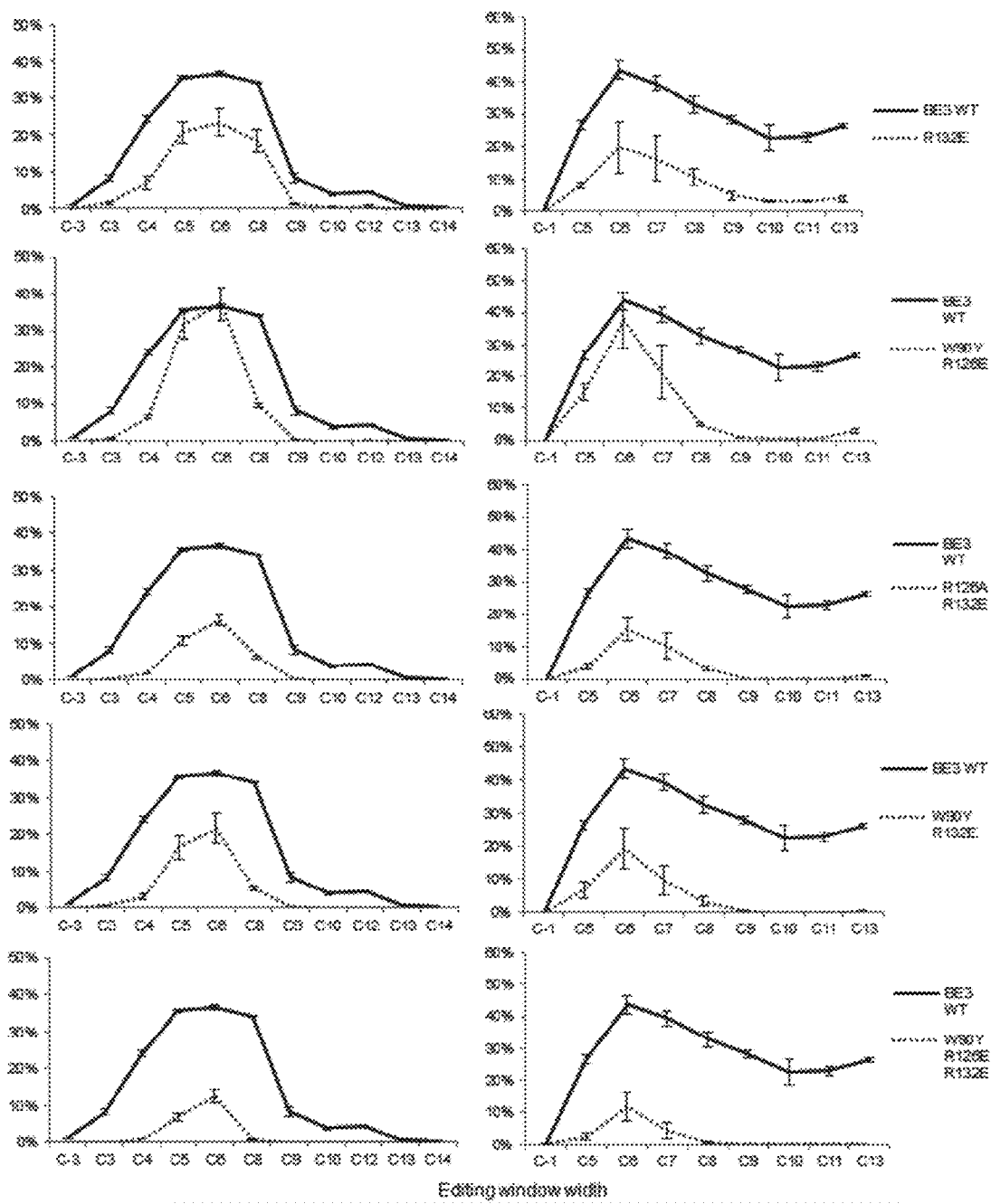

FIGS. 97A to 97C show the effect of rAPOBEC mutations on base editing window width. FIG. 97C shows HEK293T cells transfected with plasmids expressing an sgRNA targeting either Site A or Site B and the BE3 point mutants indicated. The treated cells were analyzed as described in the Examples. All C's in the protospacer and within three basepairs of the protospacer are displayed and the cellular C to T conversion percentages are shown. The 'editing window widths', defined as the calculated number of nucleotides within which editing efficiency exceeds the half-maximal value, are displayed for all tested mutants. The sequences in FIG. 97C correspond to SEQ ID NOs: 5792 and 5793 from left to right, respectively.

Figure 98:
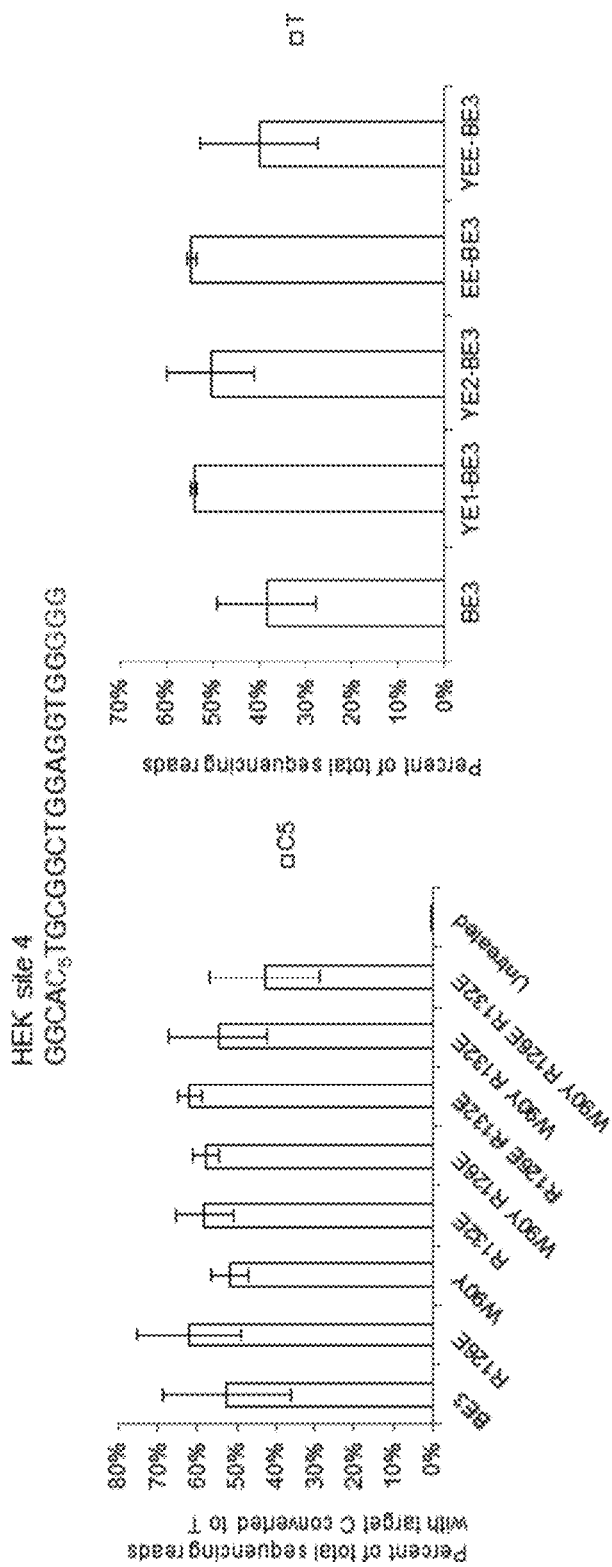

FIG. 98 shows the effect of APOBEC1 mutation son product distributions of base editing in mammalian cells. HEK293T cells were transfected with plasmids expressing BE3 or its mutants and an appropriate sgRNAs. The treated cells were analyzed as described in the Examples. Cellular C to T conversion percentages, defined as the percentage of total DNA sequencing reads with Ts at the target positions indicated, are shown (left). Percent of total sequencing reads containing the C to T conversion is shown on the right. The BE3 point mutants do not significantly affect base editing efficiencies at HEK site 4, a site with only one target cytidine. The sequence corresponds to SEQ ID NO: 297.

Figure 99:
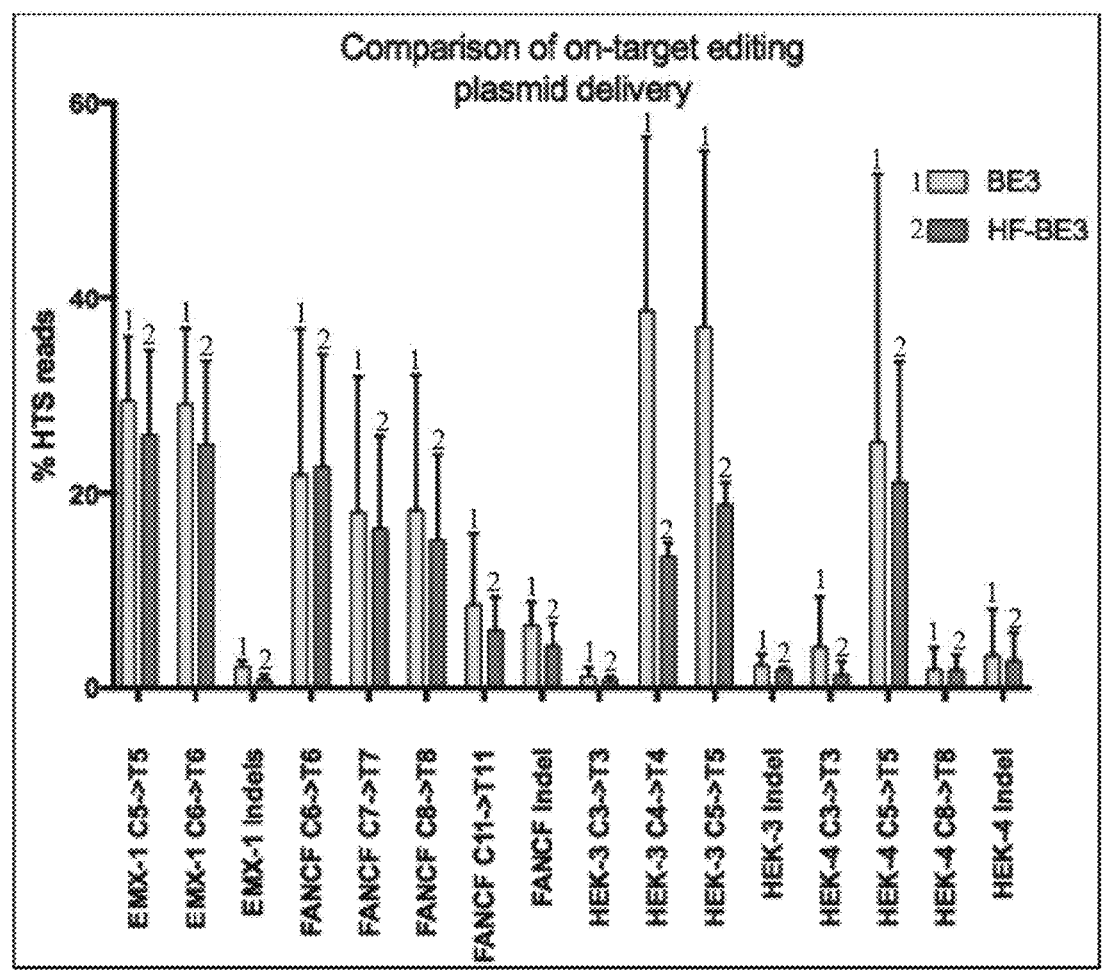

FIG. 99 shows a comparison of on-target editing plasma delivery in BE3 and HF-BE3.

Figure 100:
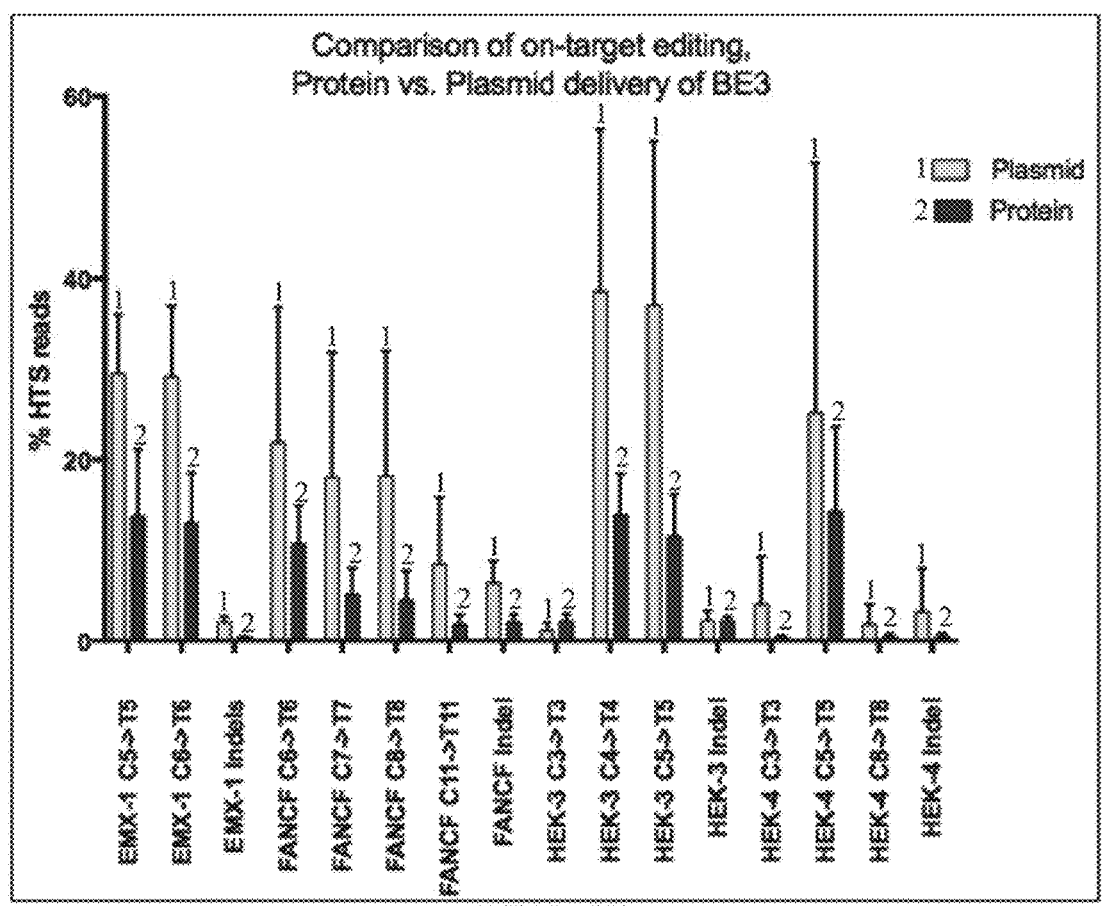

FIG. 100 shows a comparison of on-target editing in protein and plasma delivery of BE3.

Figure 101:
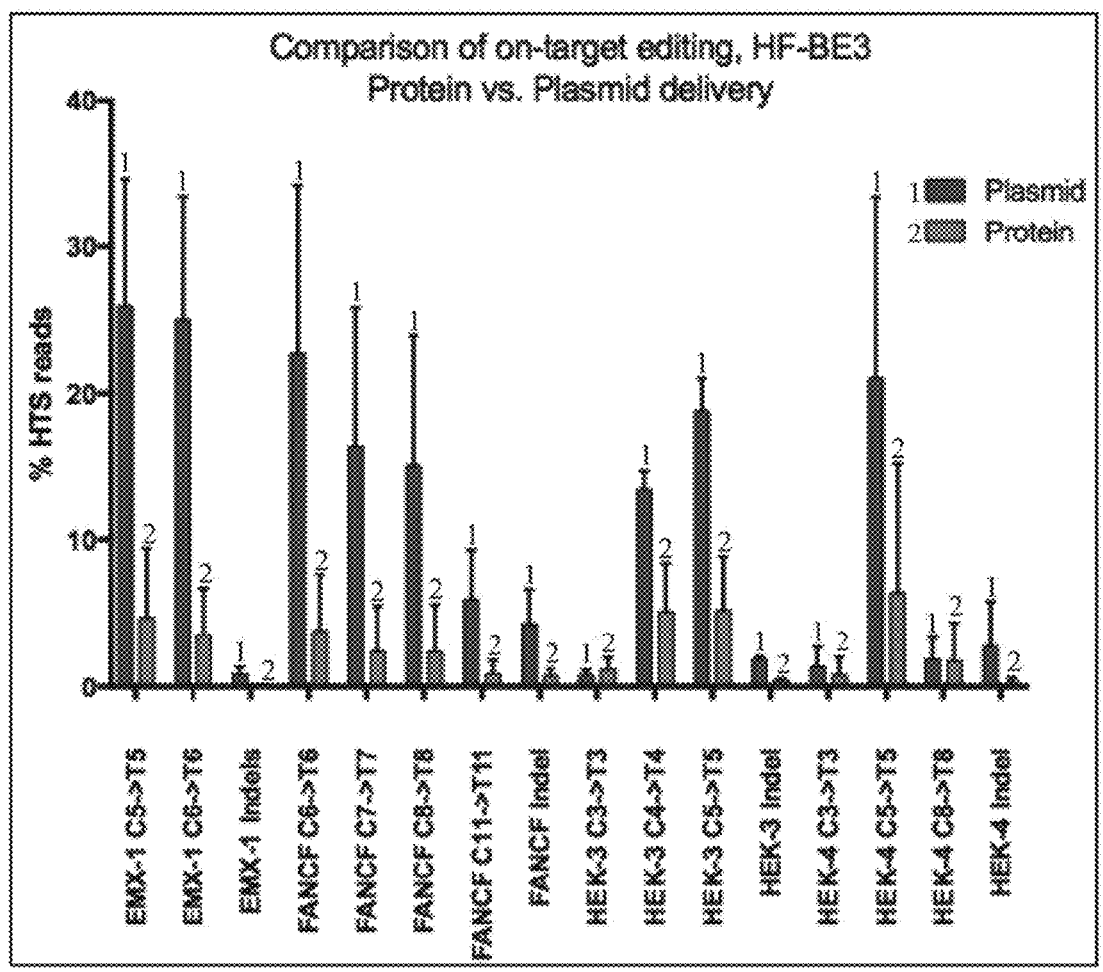

FIG. 101 shows a comparison of on-target editing in protein and plasma delivery of HF-BE3.

Figure 102:
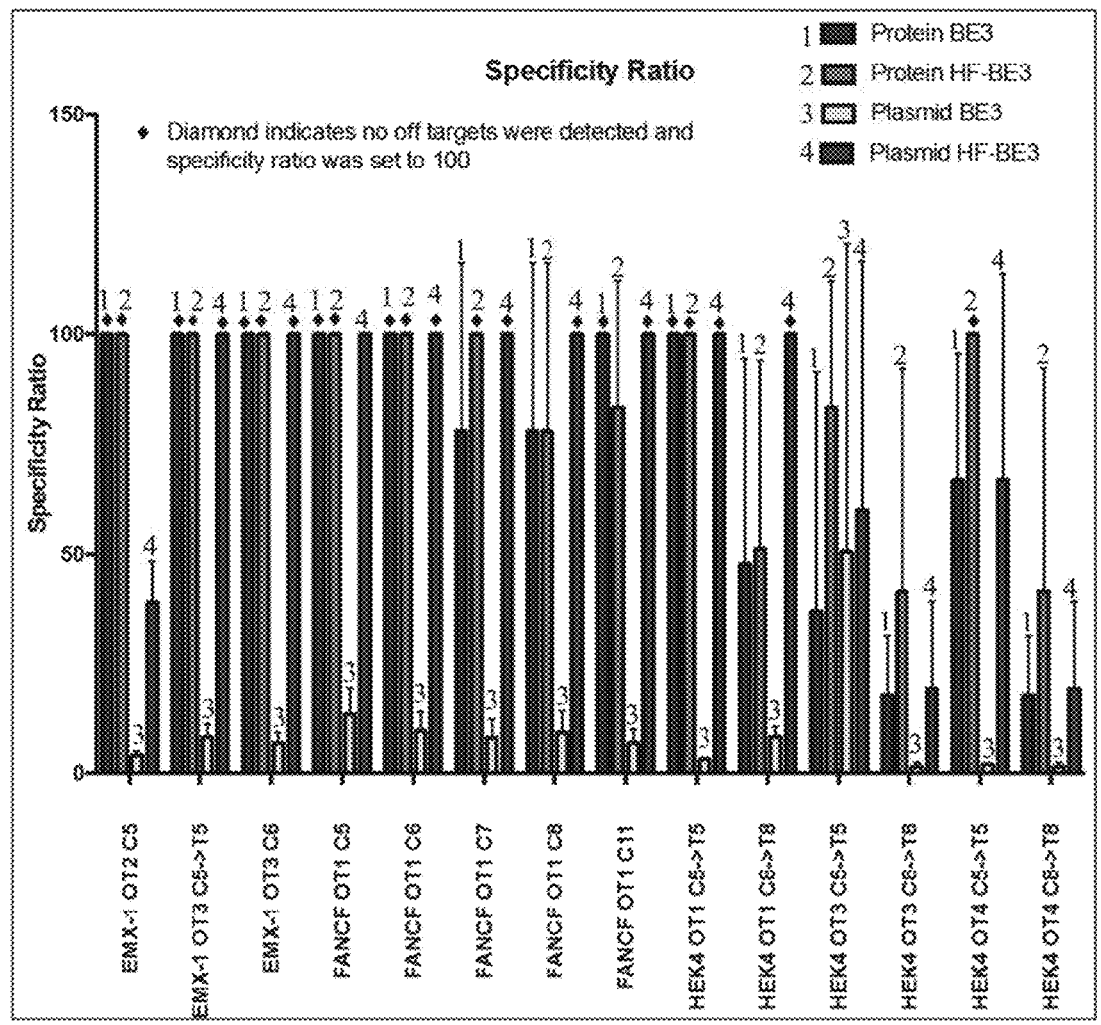

FIG. 102 shows that both lipofection and installing HF mutations decrease off-target deamination events. The diamond indicates no off targets were detected and the specificity ratio was set to 100.

Figure 103:
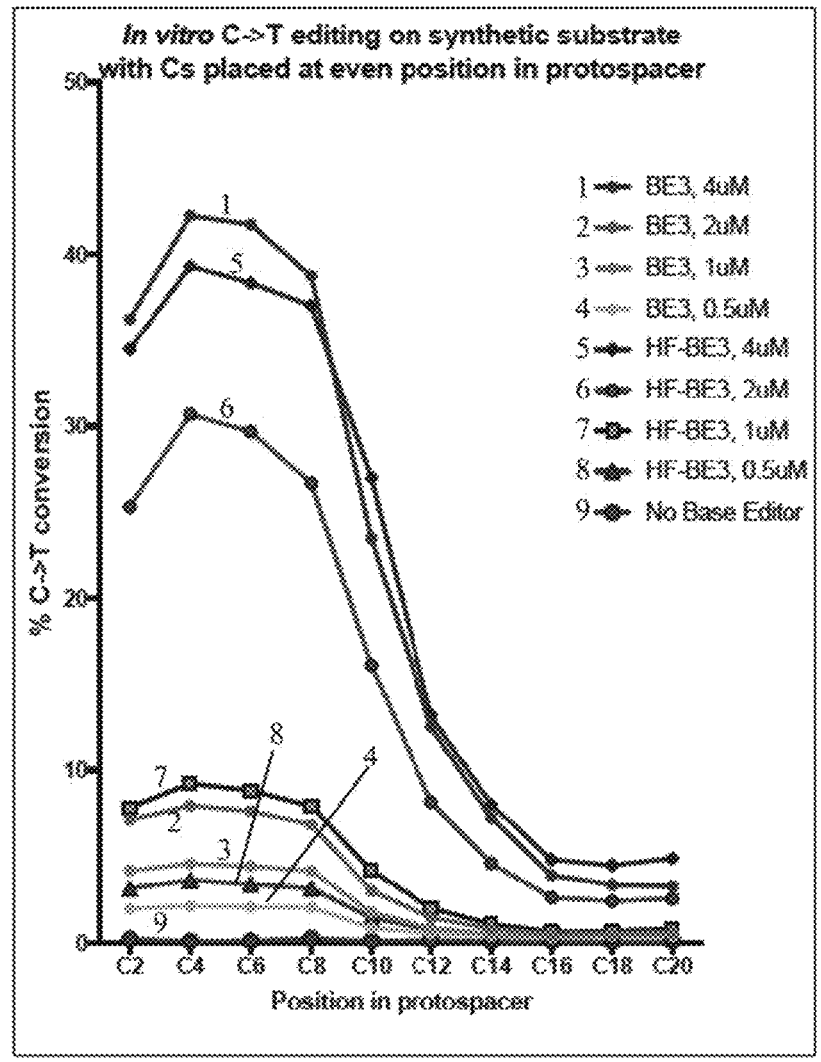

FIG. 103 shows in vitro C to T editing on a synthetic substrate with Cs placed at even positions in the protospacer (NNNNTC$_2$TC$_4$TC$_6$TC$_8$TC$_{10}$TC$_{12}$TC$_{14}$TC$_{16}$TC$_{18}$TC$_{20}$NGG, SEQ ID NO: 4272).

Figure 104:
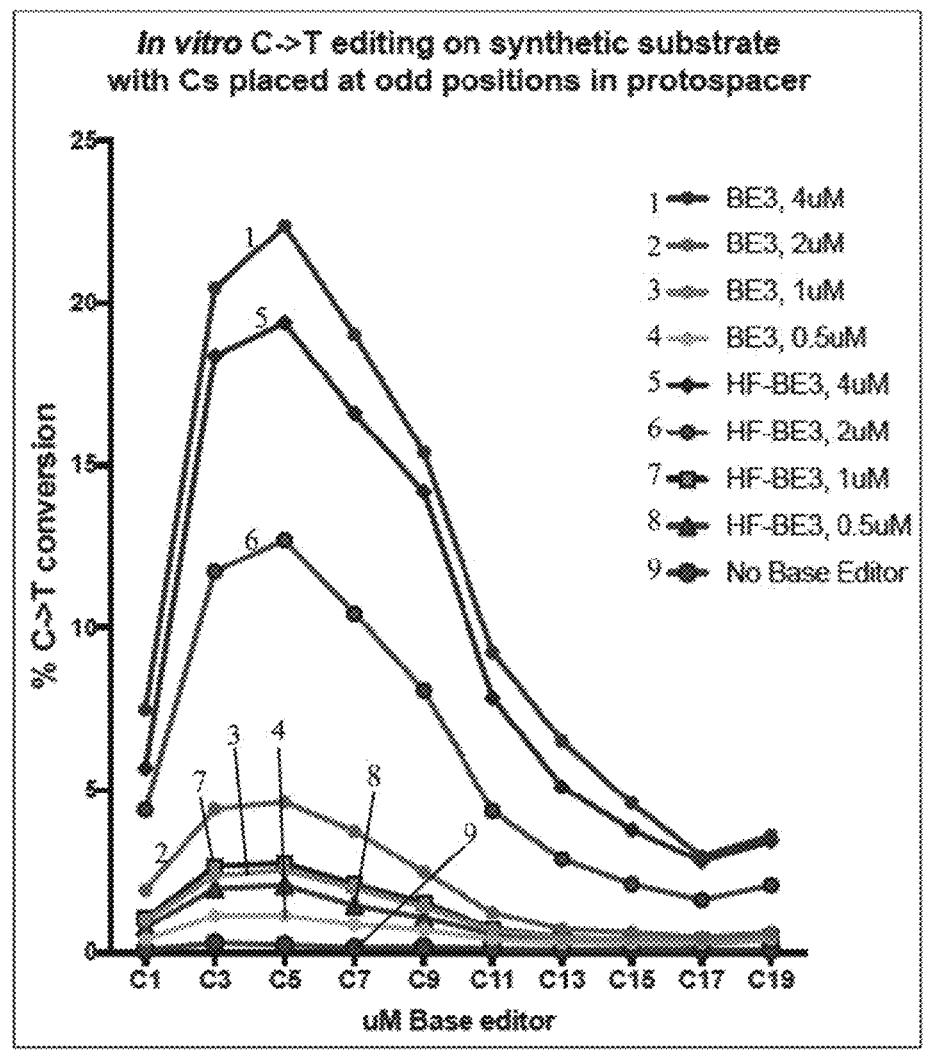

FIG. 104 shows in vitro C to T editing on a synthetic substrate with Cs placed at odd positions in the protospacer (NNNNTC$_2$TC$_4$TC$_6$TC$_8$TC$_{10}$TC$_{12}$TC$_{14}$TC$_{16}$TC$_{18}$TC$_{20}$NGG, SEQ ID NO: 4272).

Figure 105:
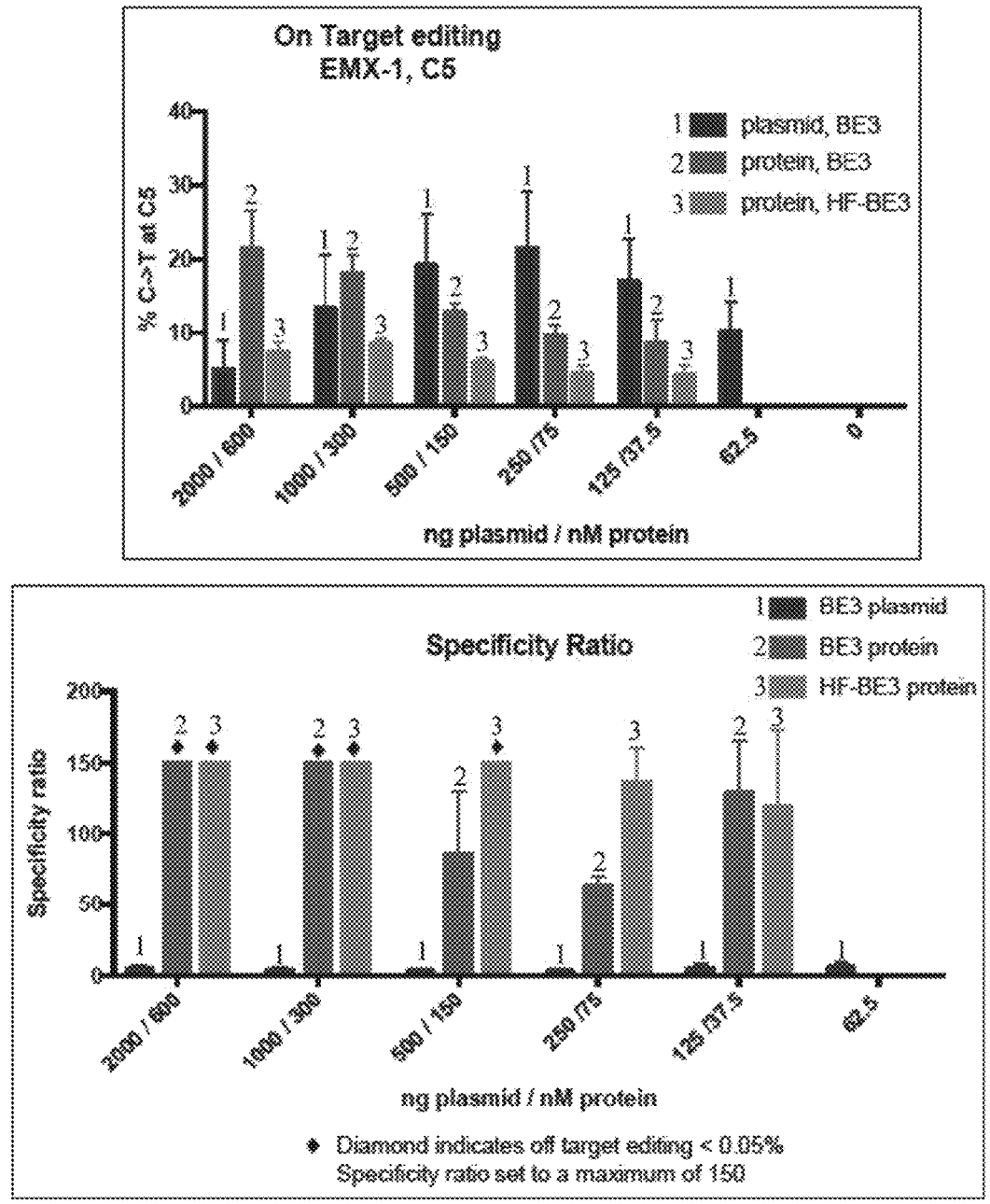

FIG. 105 includes two graphs depicting the specificity ratio of base editing with plasmid vs. protein delivery.

Figure 106A:
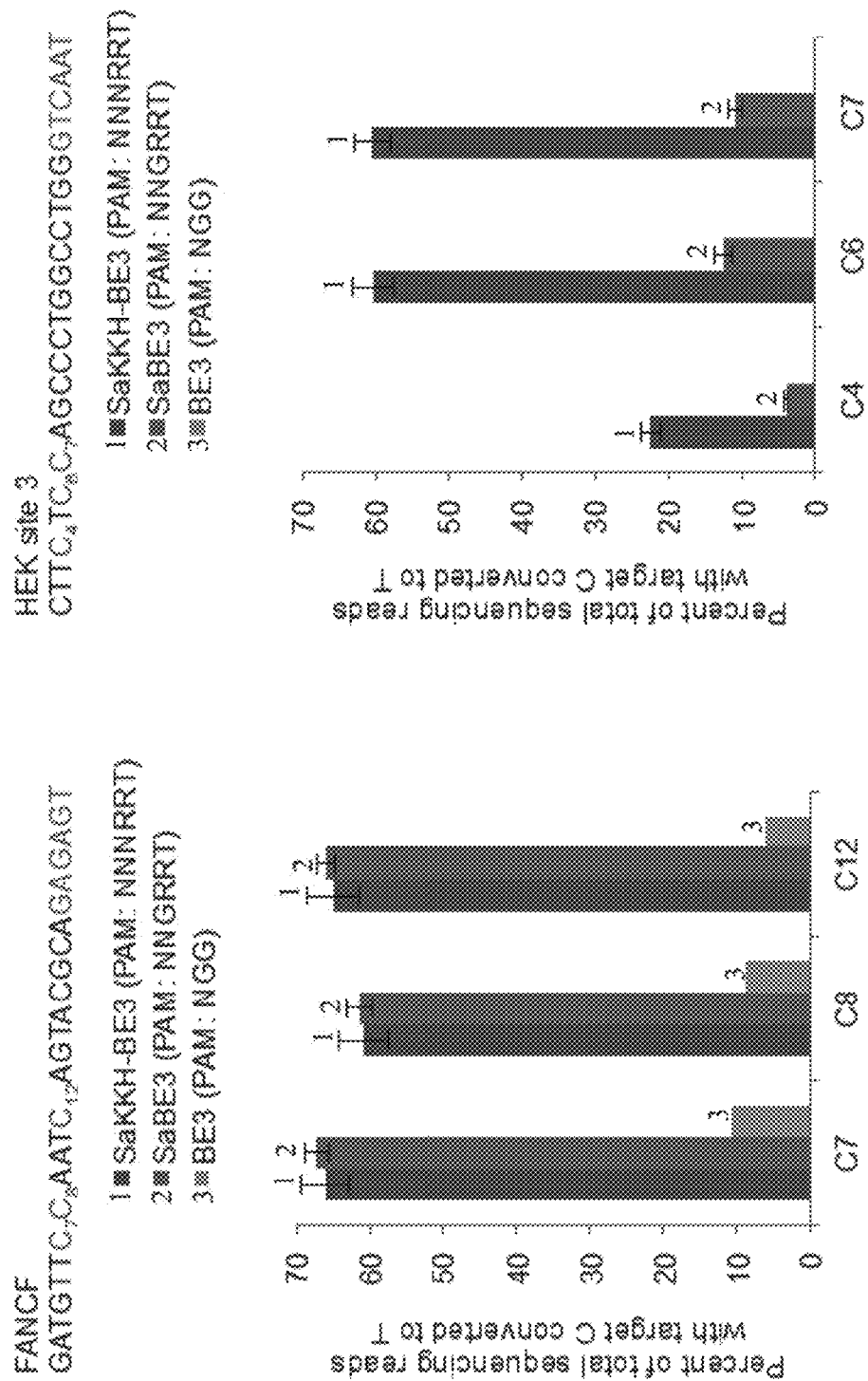
Figure 106B:
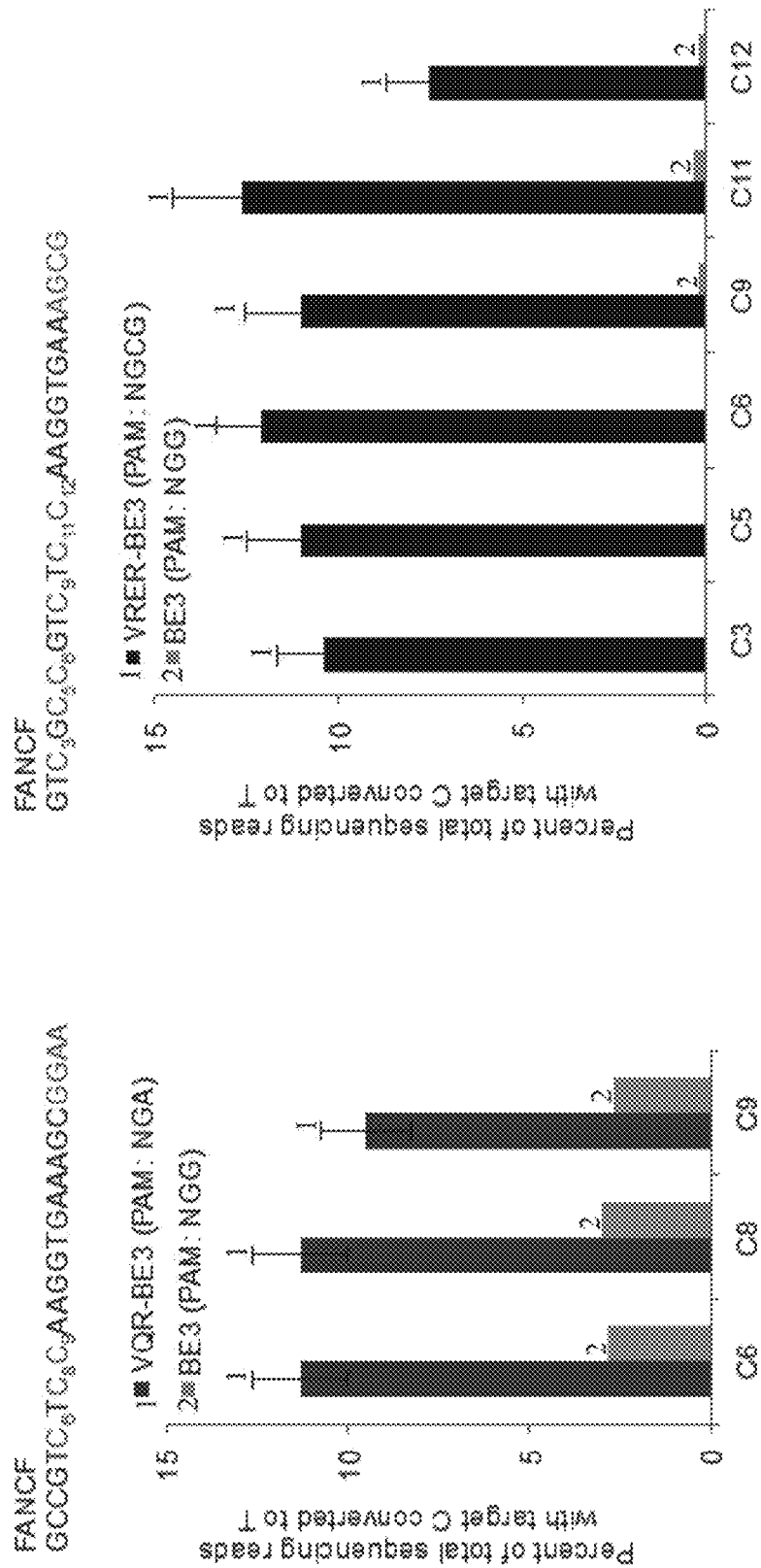

FIGS. 106A to 106B shows BE3 activity on non-NGG PAM sites. HEK293T cells were transfected with plasmids expressing BE3 and appropriate sgRNA. The treated cells were analyzed as described in the Examples. FIG. 106A shows BE3 activity on sites can be efficiently targeted by SaBE3 or SaKKH-BE3. BE3 shows low but significant activity on the NAG PAM. The sequences correspond to SEQ ID NOs: 5796 and 5797 from left to right, respectively. FIG. 106B shows BE3 has significantly reduced editing at sites with NGA or NGCG PAMs, in contrast to VQR-BE3 or VRER-BE3. The sequences correspond to SEQ ID NOs: 5798 and 5799 from left to right, respectively.

Figure 107A:
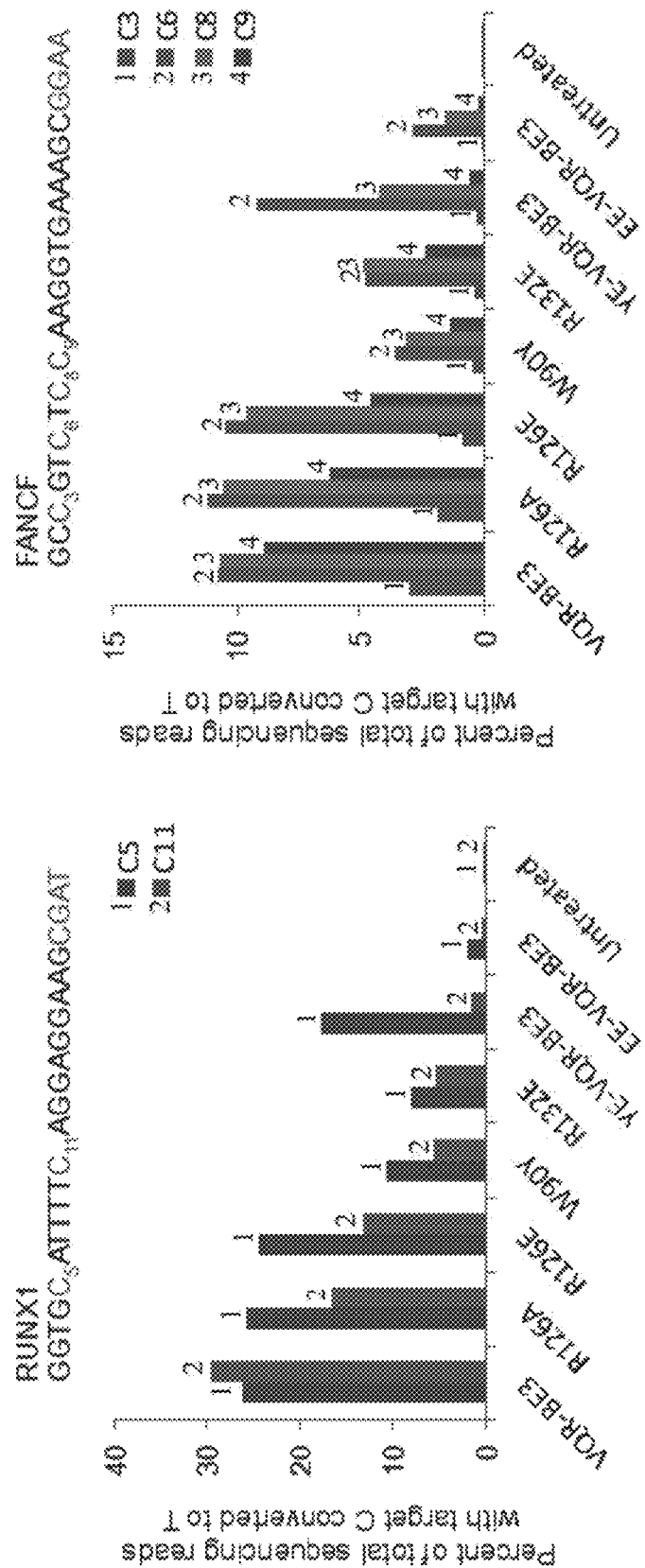
Figure 107B:
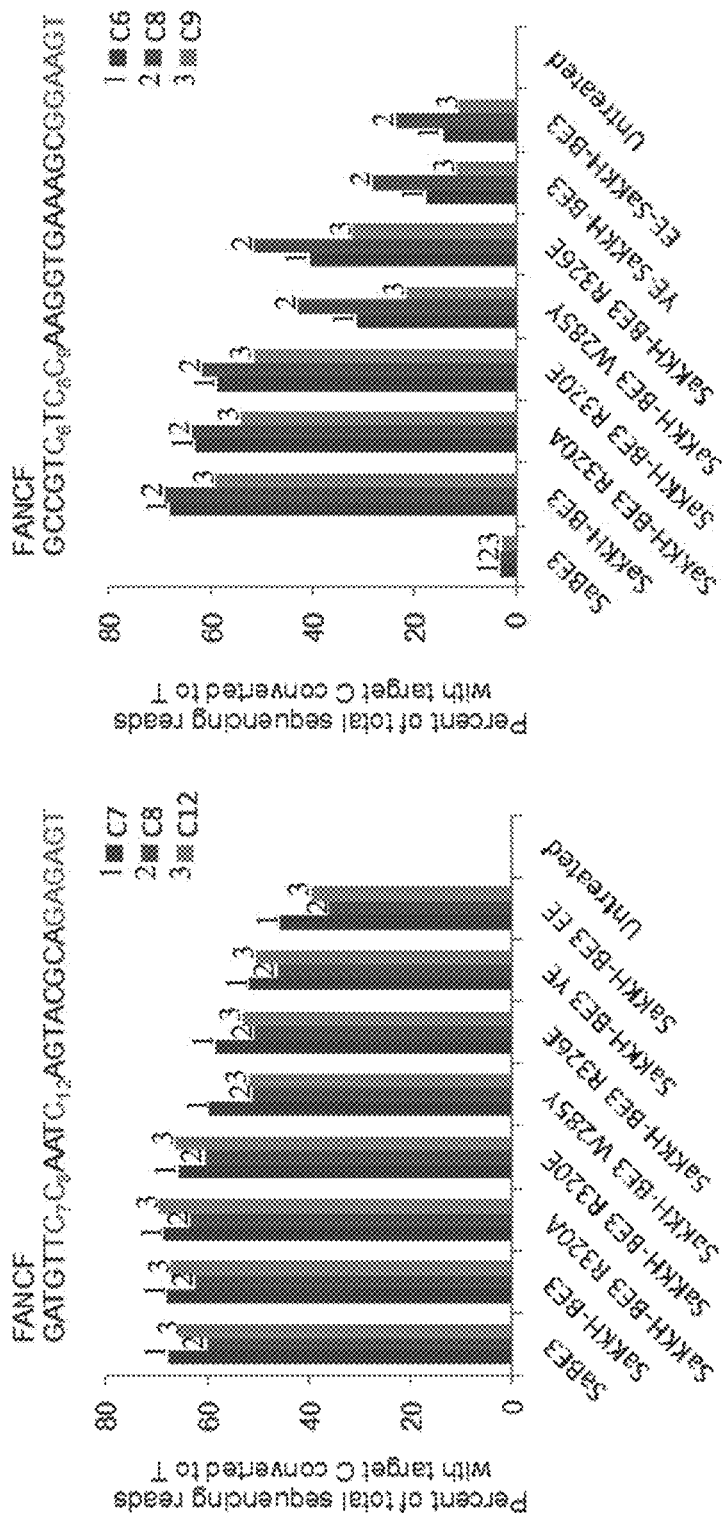

FIGS. 107A to 107B show the effect of APOBEC1 mutations on VQR-BE3 and SaKKH-BE3. HEK293T cells were transfected with plasmids expressing VQR-BE3, SaKKH-BE3 or its mutants and an appropriate sgRNAs. The treated cells were analyzed as described in the Methods. Cellular C to T conversion percentages, defined as the percentage of total DNA sequencing reads with Ts at the target positions indicated, are shown. FIG. 107A shows that the window-modulating mutations can be applied to VQR-BE3 to enable selective base editing at sites targetable by NGA PAM. The sequences correspond to SEQ ID NOs: 5800 and 5798 from left to right, respectively. FIG. 107B shows that, when applied to SaKKH-BE3, the mutations cause overall decrease in base editing efficiency without conferring base selectivity within the target window. The sequences correspond to SEQ ID NOs: 5796 and 5801 from left to right, respectively.

Figure 108:
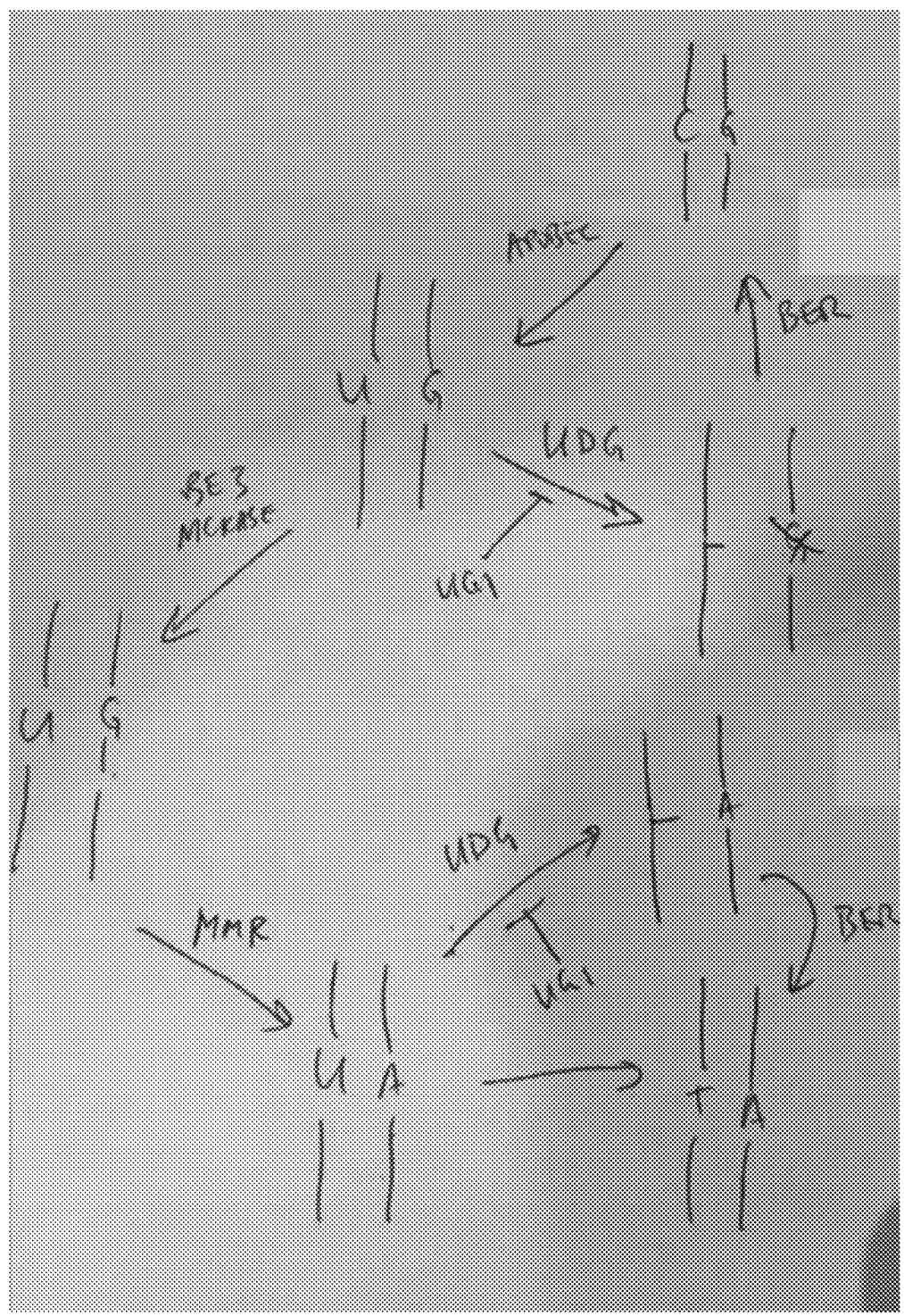

FIG. 108 shows a schematic representation of nucleotide editing. The following abbreviations are used: (MMR)—mismatch repair, (BE3 Nickase)—refers to base editor 3, which comprises a Cas9 nickase domain, (UGI)—uracil glycosylase inhibitor, UDG)—uracil DNA glycosylase, (APOBEC)—refers to an APOBEC cytidine deaminase.

DEFINITIONS

As used herein and in the claims, the singular forms "a," "an," and "the" include the singular and the plural reference unless the context clearly indicates otherwise. Thus, for example, a reference to "an agent" includes a single agent and a plurality of such agents.

The term "Cas9" or "Cas9 nuclease" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of Streptococcus pyogenes." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, SEQ ID NO:1 (nucleotide); SEQ ID NO:2 (amino acid)).

(SEQ ID NO: 1)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAAACCCT

ATTAACGCAAGTAGAGTAGATGCTAAAGCGATTCTTTCTGCACGATTGAG

TAAATCAAGACGATTAGAAAATCTCATTGCTCAGCTCCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATAGTGAAATAACTAAGGCTCCCCT

ATCAGCTTCAATGATTAAGCGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAAGTACTACCAAAACATAGTTTGCTTTATGAGTA

-continued

```
TTTTACGGTTTATAACGAATTGACAAAGGTCAAATATGTTACTGAGGGAA
TGCGAAAACCAGCATTTCTTTCAGGTGAACAGAAGAAAGCCATTGTTGAT
TTACTCTTCAAAACAAATCGAAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGCGCCTACCATGATTTGCTAAAAATT
ATTAAAGATAAAGATTTTTTGGATAATGAAGAAAATGAAGATATCTTAGA
GGATATTGTTTTAACATTGACCTTATTTGAAGATAGGGGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGATATTCAAAAAGCACAGGTGTCTGGACAAGG
CCATAGTTTACATGAACAGATTGCTAACTTAGCTGGCAGTCCTGCTATTA
AAAAAGGTATTTTACAGACTGTAAAAATTGTTGATGAACTGGTCAAAGTA
ATGGGGCATAAGCCAGAAAATATCGTTATTGAAATGGCACGTGAAAATCA
GACAACTCAAAAGGGCCAGAAAAATTCGCGAGAGCGTATGAAACGAATCG
AAGAAGGTATCAAAGAATTAGGAAGTCAGATTCTTAAAGAGCATCCTGTT
GAAAATACTCAATTGCAAAATGAAAAGCTCTATCTCTATTATCTACAAAA
TGGAAGAGACATGTATGTGGACCAAGAATTAGATATTAATCGTTTAAGTG
ATTATGATGTCGATCACATTGTTCCACAAAGTTTCATTAAAGACGATTCA
ATAGACAATAAGGTACTAACGCGTTCTGATAAAAATCGTGGTAAATCGGA
TAACGTTCCAAGTGAAGAAGTAGTCAAAAAGATGAAAAACTATTGGAGAC
AACTTCTAAACGCCAAGTTAATCACTCAACGTAAGTTTGATAATTTAACG
AAAGCTGAACGTGGAGGTTTGAGTGAACTTGATAAAGCTGGTTTTATCAA
ACGCCAATTGGTTGAAACTCGCCAAATCACTAAGCATGTGGCACAAATTT
TGGATAGTCGCATGAATACTAAATACGATGAAAATGATAAACTTATTCGA
GAGGTTAAAGTGATTACCTTAAAAATCTAAATTAGTTTCTGACTTCCGAAA
AGATTTCCAATTCTATAAAGTACGTGAGATTAACAATTACCATCATGCCC
ATGATGCGTATCTAAATGCCGTCGTTGGAACTGCTTTGATTAAGAAATAT
CCAAAACTTGAATCGGAGTTTGTCTATGGTGATTATAAAGTTTATGATGT
TCGTAAAATGATTGCTAAGTCTGAGCAAGAAATAGGCAAAGCAACCGCAA
AATATTTCTTTTACTCTAATATCATGAACTTCTTCAAAACAGAAATTACA
CTTGCAAATGGAGAGATTCGCAAACGCCCTCTAATCGAAACTAATGGGAA
AACTGGAGAAATTGTCTGGGATAAAGGGCGAGATTTTGCCACAGTGCGCA
AAGTATTGTCCATGCCCCAAGTCAATATTGTCAAGAAACAGAAGTACAG
ACAGGCGGATTCTCCAAGGAGTCAATTTTACCAAAAGAAATTCGGACAA
GCTTATTGCTCGTAAAAAAGACTGGGATCCAAAAAAATATGGTGGTTTTG
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAGACTTAATCATTAAACTACCTAAATAT
AGTCTTTTTGAGTTAGAAAACGGTCGTAAACGGATGCTGGCTAGTGCCGG
AGAATTACAAAAAGGAAATGAGCTGGCTCTGCCAAGCAAATATGTGAATT
TTTTATATTTAGCTAGTCATTATGAAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA
ATACGTGAACAAGCAGAAAATATTATTCATTTATTTACGTTGACGAATCT
TGGAGCTCCCGCTGCTTTTAAATATTTTGATACAACAATTGATCGTAAAC
GATATACGTCTACAAAAGAAGTTTTAGATGCCACTCTTATCCATCAATCC
ATCACTGGTCTTTATGAAACACGCATTGATTTGAGTCAGCTAGGAGGTGA
CTGA
```

(SEQ ID NO: 2)
MDKK<u>YSIGLDIGTNSVGWAVITDDYKVPSKKFKVLGNTDRHSIKKNLIG
ALLFGSGETA</u>EATRLKRTARRRYTRRKNRICYLQEIFSNEMAKVDDSF

FHRLEESFLVEEDKKHERHPIFGNIVDEVAYHEKYPTIYHLRKKLAD

STDKADLRLIYLALAHMIKFRGHFLIEGDLNPDNSDVDKLFIQLVQI

YNQLFEENPINASRVDAKAILSARLSKSRRLENLIAQLPGEKRNGLF

GNLIALSLGLTPNFKSNFDLAEDAKLQLSKDTYDDDLDNLLAQIGDQ

YADLFLAAKNLSDAILLSDILRVNSEITKAPLSASMIKRYDEHHQDL

TLLKALVRQQLPEKYKEIFFDQSKNGYAGYIDGGASQEEFYKFIKPI

LEKMDGTEELLVKLNREDLLRKQRTFDNGSIPHQIHLGELHAILRRQ

EDFYPFLKDNREKIEKILTFRIPYYVGPLARGNSRFAWMTRKSEETI

TPWNFEEVVDKGASAQSFIERMTNFDKNLPNEKVLPKHSLLYEYFTV

YNELTKVKYVTEGMRKPAFLSGEQKKAIVDLLFKTNRKVTVKQLKED

YFKKIECFDSVEISGVEDRFNASLGAYHDLLKIIKDKDFLDNEENE

DILEDIVLTLTLFEDRGMIEERLKTYAHLFDDKVMKQLKRRRYTGW

GRLSRKLINGIRDKQSGKTILDFLKSDGFANRNFMQLIHDDSLTFK

EDIQKAQVSGQ<u>GHSLHEQIANLAGSPAIKKGILQTVKIVDELVKVM
GHKPENIVIEMAR</u>ENQTTQKGQKNSRERMKRIEEGIKELGSQILKE

<u>HPVENTQLQNEKLYLYYLQNGRDMYVDQELDINRLSDYDVDHIVPQ

SFIKDDSIDNKVLTRSDKNRGKSDNVPSEEVVKKMKNYWRQLLNAK

LITQRKFDNLTKAERG</u>GLSELDKAGFIKRQLVETRQITKHVAQILD

SRMNTKYDENDKLIREVKVITLKSKLVSDFRKDFQFYKVREINNYH

HAHDAYLNAVVGTALIKKYPKLESEFVYGDYKVYDVRKMIAKSEQE

IGKATAKYFFYSNIMNFFKTEITLANGEIRKRPLIETNGETGEIVW

DKGRDFATVRKVLSMPQVNIVKKTEVQTGGFSKESILPKRNSDKLI

ARKKDWDPKKYGGFDSPTVAYSVLVVAKVEKGKSKKLKSVKELLGI

TIMERSSFEKNPIDFLEAKGYKEVKKDLIIKLPKYSLFELENGRKR

MLASAGELQKGNELALPSKYVNFLYLASHYEKLKGSPEDNEQKQLF

VEQHKHYLDEIIEQISEFSKRVILADANLDKVLSAYNKHRDKPIRE

QAENIIHLFTLTNLGAPAAFKYFDTTIDRKRYTSTKEVLDATLIHQ

SITGLYETRIDLSQLGGD (single underline: HNH domain; double underline: RuvC domain)

In some embodiments, wild type Cas9 corresponds to, or comprises SEQ ID NO:3 (nucleotide) and/or SEQ ID NO: 4 (amino acid):

(SEQ ID NO: 3)
ATGGATAAAAAGTATTCTATTGGTTTAGACATCGGCACTAATTCCGTTG

GATGGGCTGTCATAACCGATGAATACAAAGTACCTTCAAAGAAATTTAA

GGTGTTGGGGAACACAGACCGTCATTCGATTAAAAAGAATCTTATCGGT

GCCCTCCTATTCGATAGTGGCGAAACGGCAGAGGCGACTCGCCTGAAAC

GAACCGCTCGGAGAAGGTATACACGTCGCAAGAACCGAATATGTTACTT

ACAAGAAATTTTTAGCAATGAGATGGCCAAAGTTGACGATTCTTTCTTT

CACCGTTTGGAAGAGTCCTTCCTTGTCGAAGAGGACAAGAAACATGAAC

GGCACCCCATCTTTGGAAACATAGTAGATGAGGTGGCATATCATGAAAA

GTACCCAACGATTTATCACCTCAGAAAAAAGCTAGTTGACTCAACTGAT

AAAGCGGACCTGAGGTTAATCTACTTGGCTCTTGCCCATATGATAAAGT

TCCGTGGGCACTTTCTCATTGAGGGTGATCTAAATCCGGACAACTCGGA

TGTCGACAAACTGTTCATCCAGTTAGTACAAACCTATAATCAGTTGTTT

GAAGAGAACCCTATAAATGCAAGTGGCGTGGATGCGAAGGCTATTCTTA

GCGCCCGCCTCTCTAAATCCCGACGGCTAGAAAACCTGATCGCACAATT

ACCCGGAGAGAAGAAAAATGGGTTGTTCGGTAACCTTATAGCGCTCTCA

CTAGGCCTGACACCAAATTTTAAGTCGAACTTCGACTTAGCTGAAGATG

CCAAATTGCAGCTTAGTAAGGACACGTACGATGACGATCTCGACAATCT

ACTGGCACAAATTGGAGATCAGTATGCGGACTTATTTTTGGCTGCCAAA

AACCTTAGCGATGCAATCCTCCTATCTGACATACTGAGAGTTAATACTG

AGATTACCAAGGCGCCGTTATCCGCTTCAATGATCAAAAGGTACGATGA

ACATCACCAAGACTTGACACTTCTCAAGGCCCTAGTCCGTCAGCAACTG

CCTGAGAAATATAAGGAAATATTCTTTGATCAGTCGAAAAACGGGTACG

CAGGTTATATTGACGGCGGAGCGAGTCAAGAGGAATTCTACAAGTTTAT

CAAACCCATATTAGAGAAGATGGATGGGACGGAAGAGTTGCTTGTAAAA

CTCAATCGCGAAGATCTACTGCGAAAGCAGCGGACTTTCGACAACGGTA

GCATTCCACATCAAATCCACTTAGGCGAATTGCATGCTATACTTAGAAG

GCAGGAGGATTTTTATCCGTTCCTCAAAGACAATCGTGAAAAGATTGAG

AAAATCCTAACCTTTCGCATACCTTACTATGTGGGACCCCTGGCCCGAG

GGAACTCTCGGTTCGCATGGATGACAAGAAAGTCCGAAGAAACGATTAC

TCCATGGAATTTTGAGGAAGTTGTCGATAAAGGTGCGTCAGCTCAATCG

TTCATCGAGAGGATGACCAACTTTGACAAGAATTTACCGAACGAAAAG

TATTGCCTAAGCACAGTTTACTTTACGAGTATTTCACAGTGTACAATGA

ACTCACGAAAGTTAAGTATGTCACTGAGGGCATGCGTAAACCCGCCTTT

CTAAGCGGAGAACAGAAGAAAGCAATAGTAGATCTGTTATTCAAGACCA

ACCGCAAAGTGACAGTTAAGCAATTGAAAGAGGACTACTTTAAGAAAAT

TGAATGCTTCGATTCTGTCGAGATCTCCGGGGTAGAAGATCGATTTAAT

GCGTCACTTGGTACGTATCATGACCTCCTAAAGATAATTAAAGATAAGG

ACTTCCTGGATAACGAAGAGAATGAAGATATCTTAGAAGATATAGTGTT

GACTCTTACCCTCTTTGAAGATCGGGAAATGATTGAGGAAAGACTAAAA

ACATACGCTCACCTGTTCGACGATAAGGTTATGAAACAGTTAAAGAGGC

GTCGCTATACGGGCTGGGGACGATTGTCGCGGAAACTTATCAACGGGAT

AAGAGACAAGCAAAGTGGTAAAACTATTCTCGATTTTCTAAAGAGCGAC

GGCTTCGCCAATAGGAACTTTATGCAGCTGATCCATGATGACTCTTTAA

CCTTCAAAGAGGATATACAAAAGGCACAGGTTTCCGGACAAGGGGACTC

ATTGCACGAACATATTGCGAATCTTGCTGGTTCGCCAGCCATCAAAAAG

GGCATACTCCAGACAGTCAAAGTAGTGGATGAGCTAGTTAAGGTCATGG

GACGTCACAAACCGGAAAACATTGTAATCGAGATGGCACGCGAAAATCA

AACGACTCAGAAGGGGCAAAAAAACAGTCGAGAGCGGATGAAGAGAATA

GAAGAGGGTATTAAAGAACTGGGCAGCCAGATCTTAAAGGAGCATCCTG

TGGAAAATACCCAATTGCAGAACGAGAAACTTTACCTCTATTACCTACA

AAATGGAAGGGACATGTATGTTGATCAGGAACTGGACATAAACCGTTTA

TCTGATTACGACGTCGATCACATTGTACCCCAATCCTTTTTGAAGGACG

ATTCAATCGACAATAAAGTGCTTACACGCTCGGATAAGAACCGAGGGAA

AAGTGACAATGTTCCAAGCGAGGAAGTCGTAAAGAAAATGAAGAACTAT

TGGCGGCAGCTCCTAAATGCGAAACTGATAACGCAAAGAAAGTTCGATA

ACTTAACTAAAGCTGAGAGGGGTGGCTTGTCTGAACTTGACAAGGCCGG

ATTTATTAAACGTCAGCTCGTGGAAACCCGCCAAATCACAAAGCATGTT

GCACAGATACTAGATTCCCGAATGAATACGAAATACGACGAGAACGATA

AGCTGATTCGGGAAGTCAAAGTAATCACTTTAAAGTCAAATTGGTGTC

GGACTTCAGAAAGGATTTTCAATTCTATAAAGTTAGGGAGATAAATAAC

TACCACCATGCGCACGACGCTTATCTTAATGCCGTCGTAGGGACCGCAC

TCATTAAGAAATACCCGAAGCTAGAAAGTGAGTTTGTGTATGGTGATTA

CAAAGTTTATGACGTCCGTAAGATGATCGCGAAAAGCGAACAGGAGATA

GGCAAGGCTACAGCCAAATACTTCTTTTATTCTAACATTATGAATTTCT

TTAAGACGGAAATCACTCTGGCAAACGGAGAGATACGCAAACGACCTTT

AATTGAAACCAATGGGGAGACAGGTGAAATCGTATGGGATAAGGGCCGG

GACTTCGCGACGGTGAGAAAAGTTTTGTCCATGCCCCAAGTCAACATAG

TAAAGAAAACTGAGGTGCAGACCGGAGGGTTTTCAAAGGAATCGATTCT

TCCAAAAAGGAATAGTGATAAGCTCATCGCTCGTAAAAAGGACTGGGAC

CCGAAAAAGTACGGTGGCTTCGATAGCCCTACAGTTGCCTATTCTGTCC

TAGTAGTGGCAAAAGTTGAGAAGGGAAAATCCAAGAAACTGAAGTCAGT

CAAAGAATTATTGGGGATAACGATTATGGAGCGCTCGTCTTTTGAAAAG

AACCCCATCGACTTCCTTGAGGCGAAAGGTTACAAGGAAGTAAAAAAGG

```
ATCTCATAATTAAACTACCAAAGTATAGTCTGTTTGAGTTAGAAAATGG

CCGAAAACGGATGTTGGCTAGCGCCGGAGAGCTTCAAAAGGGGAACGAA

CTCGCACTACCGTCTAAATACGTGAATTTCCTGTATTTAGCGTCCCATT

ACGAGAAGTTGAAAGGTTCACCTGAAGATAACGAACAGAAGCAACTTTT

TGTTGAGCAGCACAAACATTATCTCGACGAAATCATAGAGCAAATTTCG

GAATTCAGTAAGAGAGTCATCCTAGCTGATGCCAATCTGGACAAAGTAT

TAAGCGCATACAACAAGCACAGGGATAAACCCATACGTGAGCAGGCGGA

AAATATTATCCATTTGTTTACTCTTACCAACCTCGGCGCTCCAGCCGCA

TTCAAGTATTTTGACACAACGATAGATCGCAAACGATACACTTCTACCA

AGGAGGTGCTAGACGCGACACTGATTCACCAATCCATCACGGGATTATA

TGAAACTCGGATAGATTTGTCACAGCTTGGGGGTGACGGATCCCCCAAG

AAGAAGAGGAAAGTCTCGAGCGACTACAAAGACCATGACGGTGATTATA

AAGATCATGACATCGATTACAAGGATGACGATGACAAGGCTGCAGGA
```

(SEQ ID NO: 4)
MDKK<u>YSIGLAIGTNSVGWAVITDEYKVPSKKFKVLGNTDRHSIKKNLIG</u>
<u>ALLFDSGETA</u>EATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQG<u>DSLHEHIANLAGSPAIKK</u>
<u>GILQTVKVVDELVKVMGRHKPENIVIEMAR</u>ENQTTQKG<u>QKNSRERMKRI</u>
<u>EEGIKELGSQILKEHPVENTQLQNEKLYLYYLQNGRDMYVDQELDINRL</u>
<u>SDYDVDHIVPQSFLKDDSIDNKVLTRSDKNRGKSDNVPSEEVVKKMKNY</u>
<u>WRQLLNAKLITQRKFDNLTKAERGGLSELDKAGFIKRQLVETRQITKHV</u>
<u>AQILDSRMNTKYDENDKLIREVKVITLKSKLVSDFRKDFQFYKVREINN</u>
<u>YHHAHDAYLNAVVGTALIKKYPKLESEFVYGDYKVYDVRKMIAKSEQEI</u>
<u>GKATAKYFFYSNIMNFFKTEITLANGEIRKRPLIETNGETGEIVWDKGR</u>
<u>DFATVRKVLSMPQVNIVKKTEVQ</u>TGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain)

In some embodiments, wild type Cas9 corresponds to Cas9 from *Streptococcus pyogenes* (NCBI Reference Sequence: NC_002737.2, SEQ ID NO: 8 (nucleotide); and Uniport Reference Sequence: Q99ZW2, SEQ ID NO: 10 (amino acid).

(SEQ ID NO: 8)
```
ATGGATAAGAAATACTCAATAGGCTTAGATATCGGCACAAATAGCGTCGG

ATGGGCGGTGATCACTGATGAATATAAGGTTCCGTCTAAAAAGTTCAAGG

TTCTGGGAAATACAGACCGCCACAGTATCAAAAAAAATCTTATAGGGGCT

CTTTTATTTGACAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGTAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAACCTACAATCAATTATTTGAAGAAAACCCT

ATTAACGCAAGTGGAGTAGATGCTAAAGCGATTCTTTCTGCACGATTGAG

TAAATCAAGACGATTAGAAAATCTCATTGCTCAGCTCCCCGGTGAGAAGA

AAAATGGCTTATTTGGGAATCTCATTGCTTTGTCATTGGGTTTGACCCCT

AATTTTAAATCAAATTTTGATTTGGCAGAAGATGCTAAATTACAGCTTTC

AAAAGATACTTACGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATACTGAAATAACTAAGGCTCCCCT

ATCAGCTTCAATGATTAAACGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAGTACTACCAAAACATAGTTTGCTTTATGAGTA

TTTTACGGTTTATAACGAATTGACAAAGGTCAAATATGTTACTGAAGGAA

TGCGAAAACCAGCATTTCTTTCAGGTGAACAGAAGAAAGCCATTGTTGAT
```

```
TTACTCTTCAAAACAAATCGAAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGTACCTACCATGATTTGCTAAAAATT
ATTAAAGATAAAGATTTTTTGGATAATGAAGAAAATGAAGATATCTTAGA
GGATATTGTTTTAACATTGACCTTATTTGAAGATAGGGAGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGACATTCAAAAAGCACAAGTGTCTGGACAAGG
CGATAGTTTACATGAACATATTGCAAATTTAGCTGGTAGCCCTGCTATTA
AAAAAGGTATTTTACAGACTGTAAAAGTTGTTGATGAATTGGTCAAAGTA
ATGGGGCGGCATAAGCCAGAAAATATCGTTATTGAAATGGCACGTGAAAA
TCAGACAACTCAAAAGGGCCAGAAAAATTCGCGAGAGCGTATGAAACGAA
TCGAAGAAGGTATCAAAGAATTAGGAAGTCAGATTCTTAAAGAGCATCCT
GTTGAAAATACTCAATTGCAAAATGAAAAGCTCTATCTCTATTATCTCCA
AAATGGAAGAGACATGTATGTGGACCAAGAATTAGATATTAATCGTTTAA
GTGATTATGATGTCGATCACATTGTTCCACAAAGTTTCCTTAAAGACGAT
TCAATAGACAATAAGGTCTTAACGCGTTCTGATAAAAATCGTGGTAAATC
GGATAACGTTCCAAGTGAAGAAGTAGTCAAAAAGATGAAAAACTATTGGA
GACAACTTCTAAACGCCAAGTTAATCACTCAACGTAAGTTTGATAATTTA
ACGAAAGCTGAACGTGGAGGTTTGAGTGAACTTGATAAAGCTGGTTTTAT
CAAACGCCAATTGGTTGAAACTCGCCAAATCACTAAGCATGTGGCACAAA
TTTTGGATAGTCGCATGAATACTAAATACGATGAAAATGATAAACTTATT
CGAGAGGTTAAAGTGATTACCTTAAAATCTAAATTAGTTTCTGACTTCCG
AAAAGATTTCCAATTCTATAAAGTACGTGAGATTAACAATTACCATCATG
CCCATGATGCGTATCTAAATGCCGTCGTTGGAACTGCTTTGATTAAGAAA
TATCCAAAACTTGAATCGGAGTTTGTCTATGGTGATTATAAAGTTTATGA
TGTTCGTAAAATGATTGCTAAGTCTGAGCAAGAAATAGGCAAAGCAACCG
CAAAATATTTCTTTTACTCTAATATCATGAACTTCTTCAAAACAGAAATT
ACACTTGCAAATGGAGAGATTCGCAAACGCCCTCTAATCGAAACTAATGG
GGAAACTGGAGAAATTGTCTGGGATAAAGGGCGAGATTTTGCCACAGTGC
GCAAAGTATTGTCCATGCCCCAAGTCAATATTGTCAAGAAAACAGAAGTA
CAGACAGGCGGATTCTCCAAGGAGTCAATTTTACCAAAAAGAAATTCGGA
CAAGCTTATTGCTCGTAAAAAAGACTGGGATCCAAAAAAATATGGTGGTT
TTGATAGTCCAACGGTAGCTTATTCAGTCCTAGTGGTTGCTAAGGTGAAA
AAAGGGAAATCGAAGAAGTTAAAATCCGTTAAAGAGTTACTAGGGATCAC
AATTATGGAAAGAAGTTCCTTTGAAAAAAATCCGATTGACTTTTTAGAAG
CTAAAGGATATAAGGAAGTTAAAAAAGACTTAATCATTAAACTACCTAAA
TATAGTCTTTTTGAGTTAGAAAACGGTCGTAAACGGATGCTGGCTAGTGC
CGGAGAATTACAAAAAGGAAATGAGCTGGCTCTGCCAAGCAAATATGTGA
ATTTTTTATATTTAGCTAGTCATTATGAAAAGTTGAAGGGTAGTCCAGAA
GATAACGAACAAAAACAATTGTTTGTGGAGCAGCATAAGCATTATTTAGA
TGAGATTATTGAGCAAATCAGTGAATTTTCTAAGCGTGTTATTTTAGCAG
ATGCCAATTTAGATAAAGTTCTTAGTGCATATAACAAACATAGAGACAAA
CCAATACGTGAACAAGCAGAAAATATTATTCATTTATTTACGTTGACGAA
TCTTGGAGCTCCCGCTGCTTTTAAATATTTTGATACAACAATTGATCGTA
AACGATATACGTCTACAAAAGAAGTTTTAGATGCCACTCTTATCCATCAA
TCCATCACTGGTCTTTATGAAACACGCATTGATTTGAGTCAGCTAGGAGG
TGACTGA
```

(SEQ ID NO: 10)
MDKK<u>YSIGLDIGTNSVGWAVITDEYKVPSKKFKVLGNTDRHSIKKNLIGA</u>
<u>LLFDSGET</u>AEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV</u>
<u>MGRHKPENIVIEMAR</u>ENQTTQKGQKNSRERMKRIEEGIKELGSQILKEHP
VENTQLQNEKLYLYYLQNGRDMYVDQELDINRLSDYDVDHIVPQSFLKDD
<u>SIDNKVLTRSDKNRGKSDNVPSEEVVKKMKNYWRQLLNAKLITQRKFDNL</u>
<u>TKAERGGLSELDKAGFIKRQLVETRQITKHVAQILDSRMNTKYDENDKLI</u>
<u>REVKVITLKSKLVSDFRKDFQFYKVREINNYHHAHDAYLNAVVGTALIKK</u>
<u>YPKLESEFVYGDYKVYDVRKMIAKSEQEIGKATAKYFFYSNIMNFFKTEI</u>
<u>TLANGEIRKRPLIETNGETGEIVWDKGRDFATVRKVLSMPQVNIVKKTEV</u>
<u>QT</u>GGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD 10) (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs:

NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any of the organisms listed in Example 5.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and/or H840A mutation.

histidine in the amino acid sequence provided in SEQ ID NO: 10, or at corresponding positions in any of the amino acid sequences provided in SEQ ID NOs: 11-260. Without wishing to be bound by any particular theory, the presence of the catalytic residue H840 restores the acvitity of the Cas9 to cleave the non-edited (e.g., non-deaminated) strand containing a G opposite the targeted C. Restoration of H840 (e.g., from A840) does not result in the cleavage of the target strand containing the C. Such Cas9 variants are able to generate a single-strand DNA break (nick) at a specific location based on the gRNA-defined target sequence, leading to repair of the non-edited strand, ultimately resulting in a G to A change on the non-edited strand. A schematic representation of this process is shown in FIG. 108. Briefly, the C of a C-G basepair can be deaminated to a U by a (SEQ ID NO: 9)

dCas9 (D10A and H840A):

MDKKYSIGLAIGTNSVGWAVITDEYKVPSKKFKVLGNTDRHSIKKNLIGALLFDS

GETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLI

EGDLNPDNSDVDKLFIQLVQTYNQLFEENPINASGVDAKAILSARLSKSRRLENLIAQ

LPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQL

PEKYKEIFFDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYYVGPLARGNSR

FAWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFAN

RNFMQLIHDDSLTFKEDIQKAQVSGQG⟦DSLHEHIANLAGSPAIKKGILQTVKVVDEL⟧

⟦VKVMGRHKPENIVIEMA⟧RENQTTQKGQKNSRERMKRIEEGIKELGSQILKEHPVE

NTQLQNEKLYLYYLQNGRDMYVDQELDINRLSDYDVDAIVPQSFLKDDSIDNKV

LTRSDKNRGKSDNVPSEEVVKKMKNYWRQLLNAKLITQRKFDNLTKAERG⟦GLS⟧

⟦ELDKAGFIKRQLVETRQITKHVAQILDSRMNTKYDENDKLIREVKVITLKSKLVSDFR⟧

⟦KDFQFYKVREINNYHHAHDAYLNAVVGTALIKKYPKLESEFVYGDYKVYDVRKMI⟧

⟦AKSEQEIGKATAKYFFYSNIMNFFKTEITLANGEIRKRPLIETNGETGEIVWDKGRDF⟧

⟦ATVRKVLSMPQVNIVKKTEVQT⟧GGFSKESILPKRNSDKLIARKKDWDPDDYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGD (single underline: HNH domain; double underline: RuvC domain).

In some embodiments, the Cas9 domain comprises a D10A mutation, while the residue at position 840 remains a deaminase, e.g., an APOBEC deamonase. Nicking the non-edited strand, having the G, facilitates removal of the G via mismatch repair mechanisms. UGI inhibits UDG, which prevents removal of the U.

In other embodiments, dCas9 variants having mutations other than D10A and H840A are provided, which, e.g., result in nuclease inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 10) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 10) are provided having amino acid sequences which are shorter, or longer than SEQ ID NO: 10, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all. Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytidine deaminase domain, catalyzing the hydrolytic deamination of cytosine to uracil. In some embodiments, the deaminase or deaminase domain is a naturally-occuring deaminase from an organism, such as a human, chimpanzee, gorilla, monkey, cow, dog, rat, or mouse. In some embodiments, the deaminase or deaminase domain is a variant of a naturally-occuring deaminase from an organism, that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occuring deaminase from an organism.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a fusion protein provided herein, e.g., of a fusion protein comprising a nuclease-inactive Cas9 domain and a nucleic acid editing domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nuclease, a deaminase, a recombinase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). In some embodiments, a linker joins a gRNA binding domain of an RNA-programmable nuclease, including a Cas9 nuclease domain, and the catalytic domain of anucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g.,2'-fluororibose, ribose, 2'-deoxyribose, arabinose, and hexose); and/or modified phosphate groups (e.g., phosphorothioates and 5'-N-phosphoramidite linkages).

The term "nucleic acid editing domain," as used herein refers to a protein or enzyme capable of making one or more modifications (e.g., deamination of a cytidine residue) to a nucleic acid (e.g., DNA or RNA). Exemplary nucleic acid editing domains include, but are not limited to a deaminase, a nuclease, a nickase, a recombinase, a methyltransferase, a methylase, an acetylase, an acetyltransferase, a transcriptional activator, or a transcriptional repressor domain. In some embodiments the nucleic acid editing domain is a deaminase (e.g., a cytidine deaminase, such as an APOBEC or an AID deaminase).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* ($4^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821(2012), the entire contents of which is incorporated herein by reference.

Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. Multiplex genome engineering using CRISPR/Cas systems. *Science* 339, 819-823 (2013); Mali, P. et al. RNA-guided human genome engineering via Cas9. *Science* 339, 823-826 (2013); Hwang, W. Y. et al. Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

The term "nucleobase editors (NBEs)" or "base editors (BEs)," as used herein, refers to the Cas9 fusion proteins described herein. In some embodiments, the fusion protein comprises a nuclease-inactive Cas9 (dCas9) fused to a deaminase. In some embodiments, the fusion protein comprises a Cas9 nickase fused to a deaminase. In some embodiments, the fusion protein comprises a nuclease-inactive Cas9 fused to a deaminase and further fused to a UGI domain. In some embodiments, the fusion protein comprises a Cas9 nickase fused to a deaminase and further fused to a UGI domain. In some embodiments, the dCas9 of the fusion protein comprises a D10A and a H840A mutation of SEQ ID NO: 10, or a corresponding mutation in any of SEQ ID NOs: 11-260, which inactivates nuclease activity of the Cas9 protein. In some embodiments, the fusion protein comprises a D10A mutation and comprises a histidine at residue 840 of SEQ ID NO: 10, or a corresponding mutation in any of SEQ ID NOs: 11-260, which renders Cas9 capable of cleaving only one strand of a nucleic acid duplex. An example of a Cas9 nickase is shown below in SEQ ID NO: 674. The terms "nucleobase editors (NBEs)" and "base editors (BEs)" may be used interchangeably.

The term "uracil glycosylase inhibitor" or "UGI," as used herein, refers to a protein that is capable of inhibiting a uracil-DNA glycosylase base-excision repair enzyme.

The term "Cas9 nickase," as used herein, refers to a Cas9 protein that is capable of cleaving only one strand of a duplexed nucleic acid molecule (e.g., a duplexed DNA molecule). In some embodiments, a Cas9 nickase comprises a D10A mutation and has a histidine at position H840 of SEQ ID NO: 10, or a corresponding mutation in any of SEQ ID NOs: 11-260. For example, a Cas9 nickase may comprise the amino acid sequence as set forth in SEQ ID NO: 674. Such a Cas9 nickase has an active HNH nuclease domain and is able to cleave the non-targeted strand of DNA, i.e., the strand bound by the gRNA. Further, such a Cas9 nickase has an inactive RuvC nuclease domain and is not able to cleave the targeted strand of the DNA, i.e., the strand where base editing is desired.

Exemplary Cas9 nickase (Cloning vector pPlatTET-gRNA2; Accession No. BAV54124).

(SEQ ID NO: 674)
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD

DETAILED DESCRIPTION OF CERTAIN EMBODIMENTS OF THE INVENTION

Some aspects of this disclosure provide fusion proteins that comprise a domain capable of binding to a nucleotide sequence (e.g., a Cas9, or a Cpf1 protein) and an enzyme domain, for example, a DNA-editing domain, such as, e.g., a deaminase domain. The deamination of a nucleobase by a deaminase can lead to a point mutation at the respective residue, which is referred to herein as nucleic acid editing. Fusion proteins comprising a Cas9 variant or domain and a DNA editing domain can thus be used for the targeted editing of nucleic acid sequences. Such fusion proteins are useful for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a subject. Typically, the Cas9 domain of the fusion proteins described herein does not have any nuclease activity but instead is a Cas9 fragment or a dCas9 protein or domain. Methods for the use of Cas9 fusion proteins as described herein are also provided.

Cas9 Domains of Nucleobase Editors

Non-limiting, exemplary Cas9 domains are provided herein. The Cas9 domain may be a nuclease active Cas9 domain, a nucleasae inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 11-260. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 11-260. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 11-260. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 11-260.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 10, or a corresponding mutation in any of the amino acid sequences provided in SEQ ID NOs: 11-260, wherein X is any amino acid change. In some embodiments, the nuclease-inactive dCas9 domain comprises a D10A mutation and a H840A mutation of the amino acid sequence set forth in SEQ ID NO: 10, or a corresponding mutation in any of the amino acid sequences provided in SEQ ID NOs: 11-260. As one example, a nuclease-inactive Cas9 domain comprises the amino acid sequence set forth in SEQ ID NO: 263 (Cloning vector pPlatTET-gRNA2, Accession No. BAV54124).

(SEQ ID NO: 263)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD;

see, e.g., Qi et al., Repurposing CRISPR as an RNA-guided platform for sequence-specific control of gene expression. *Cell.* 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 11-260. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 11-260.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 10, or a mutation in any of SEQ ID NOs: 11-260. For example, a Cas9 nickase may comprise the amino acid sequence as set forth in SEQ ID NO: 674. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 10, or a corresponding mutation in any of SEQ ID NOs: 11-260. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 4273. In some embodiments, the SaCas9 comprises a N579X mutation of SEQ ID NO: 4273, or a corresponding mutation in any of the amino acid sequences provided in SEQ ID NOs: 11-260, wherein X is any amino acid except for N. In some embodiments, the SaCas9 comprises a N579A mutation of SEQ ID NO: 4273, or a corresponding mutation in any of the amino acid sequences provided in SEQ ID NOs: 11-260. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation of SEQ ID NO: 4273, or a corresponding mutation in any of the amino acid sequences provided in SEQ ID NOs: 11-260, wherein X is any amino acid. In some embodiments, the SaCas9 domain comprises one or more of a E781K, a N967K, and a R1014H mutation of SEQ ID NO: 4273, or one or more corresponding mutation in any of the amino acid sequences provided in SEQ ID NOs: 11-260. In some embodiments, the SaCas9 domain comprises a E781K, a N967K, or a R1014H mutation of SEQ ID NO: 4273, or corresponding mutations in any of the amino acid sequences provided in SEQ ID NOs: 11-260.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 4273-4275. In some embodiments, the Cas9 domain of any of the fusion proteins provided herein comprises the amino acid sequence of any one of SEQ ID NOs: 4273-4275. In some embodiments, the Cas9 domain of any of the fusion proteins provided herein consists of the amino acid sequence of any one of SEQ ID NOs: 4273-4275.

Exemplary SaCas9 sequence (SEQ ID NO: 4273)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

-continued
AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 of SEQ ID NO: 4273, which is underlined and in bold, may be mutated (e.g., to a A579) to yield a SaCas9 nickase.

Exemplary SaCas9n Sequence (SEQ ID NO: 4274)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG.

Residue A579 of SEQ ID NO: 4274, which can be mutated from N579 of SEQ ID NO: 4273 to yield a SaCas9 nickase, is underlined and in bold.

Exemplary SaKKH Cas9

(SEQ ID NO: 4275)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNR*KL*IN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFY*K*NDLIKINGELYRV

IGVNNDLLNRIEVNMIDITYREYLENMNDKRPP*H*IIKTIASKTQSIKKY

STDILGNLYEVKSKKHPQIIKKG.

Residue A579 of SEQ ID NO: 4275, which can be mutated from N579 of SEQ ID NO: 4273 to yield a SaCas9 nickase, is underlined and in bold. Residues K781, K967, and H1014 of SEQ ID NO: 4275, which can be mutated from E781, N967, and R1014 of SEQ ID NO: 4273 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 4276. In some embodiments, the SpCas9 comprises a D9X mutation of SEQ ID NO: 4276, or a corresponding mutation in any of the amino acid sequences provided in SEQ ID NOs: 11-260, wherein X is any amino acid except for D. In some embodiments, the SpCas9 comprises a D9A mutation of SEQ ID NO: 4276, or a corresponding mutation in any of the amino acid sequences provided in SEQ ID NOs: 11-260. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134E, R1334Q, and T1336R mutation of SEQ ID NO: 4276, or a corresponding mutation in any of the amino acid sequences provided in SEQ ID NOs: 11-260. In some embodiments, the SpCas9 domain comprises a D1134E, a R1334Q, and a T1336R mutation of SEQ ID NO: 4276, or corresponding mutations in any of the amino acid sequences provided in SEQ ID NOs: 11-260. In some embodiments, the SpCas9 domain comprises one or more of a D1134X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134V, a R1334Q, and a T1336R mutation of SEQ ID NO: 4276, or a corresponding mutation in any of the amino acid sequences provided in SEQ ID NOs: 11-260. In some embodiments, the SpCas9 domain comprises a D1134V, a R1334Q, and a T1336R mutation of SEQ ID NO: 4276, or corresponding mutations in any of the amino acid sequences provided in SEQ ID NOs: 11-260. In some embodiments, the SpCas9 domain comprises one or more of a D1134X, a G1217X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134V, a G1217R, a R1334Q, and a T1336R mutation of SEQ ID NO: 4276, or a corresponding mutation in any of the amino acid sequences provided in SEQ ID NOs: 11-260. In some embodiments, the SpCas9 domain comprises a D1134V, a G1217R, a R1334Q, and a T1336R mutation of SEQ ID NO: 4276, or corresponding mutations in any of the amino acid sequences provided in SEQ ID NOs: 11-260.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 4276-4280. In some embodiments, the Cas9 domain of any of the fusion proteins provided herein comprises the amino acid sequence of any one of SEQ ID NOs: 4276-4280. In some embodiments, the Cas9 domain of any of the fusion proteins provided herein consists of the amino acid sequence of any one of SEQ ID NOs: 4276-4280.

Exemplary SpCas9

(SEQ ID NO: 4276)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n (SEQ ID NO: 4277)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9

(SEQ ID NO: 4278)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD

Residues E1134, Q1334, and R1336 of SEQ ID NO: 4278, which can be mutated from D1134, R1334, and T1336 of SEQ ID NO: 4276 to yield a SpEQR Cas9, are underlined and in bold.

Exemplary SpVQR Cas9

(SEQ ID NO: 4279)
DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSF

FHRLEESFLVEEDKKHERHPIFGNIVDEVAYHEKYPTIYHLRKKLVDS

TDKADLRLIYLALAHMIKFRGHFLIEGDLNPDNSDVDKLFIQLVQTYN

QLFEENPINASGVDAKAILSARLSKSRRLENLIAQLPGEKKNGLFGNL

IALSLGLTPNFKSNFDLAEDAKLQLSKDTYDDDLDNLLAQIGDQYADL

FLAAKNLSDAILLSDILRVNTEITKAPLSASMIKRYDEHHQDLTLLKA

LVRQQLPEKYKEIFFDQSKNGYAGYIDGGASQEEFYKFIKPILEKMDG

TEELLVKLNREDLLRKQRTFDNGSIPHQIHLGELHAILRRQEDFYPFL

KDNREKIEKILTFRIPYYVGPLARGNSRFAWMTRKSEETITPWNFEEV

VDKGASAQSFIERMTNFDKNLPNEKVLPKHSLLYEYFTVYNELTKVKY

VTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTL

FEDREMIEERLKTYAHLFDDKVMKQLKRRRYTGWGRLSRKLINGIRDK

QSGKTILDFLKSDGFANRNFMQLIHDDSLTFKEDIQKAQVSGQGDSLH

EHIANLAGSPAIKKGILQTVKVVDELVKVMGRHKPENIVIEMARENQT

TQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRG

KSDNVPSEEVVKKMKNYWRQLLNAKLITQRKFDNLTKAERGGLSELDK

AGFIKRQLVETRQITKHVAQILDSRMNTKYDENDKLIREVKVITLKSK

LVSDFRKDFQFYKVREINNYHHAHDAYLNAVVGTALIKKYPKLESEFV

YGDYKVYDVRKMIAKSEQEIGKATAKYFFYSNIMNFFKTEITLANGEI

RKRPLIETNGETGEIVWDKGRDFATVRKVLSMPQVNIVKKTEVQTGGF

SKESILPKRNSDKLIARKKDWDPKKYGGFVSPTVAYSVLVVAKVEKGK

SKKLKSVKELLGITIMERSSFEKNPIDFLEAKGYKEVKKDLIIKLPKY

SLFELENGRKRMLASAGELQKGNELALPSKYVNFLYLASHYEKLKGSP

EDNEQKQLFVEQHKHYLDEIIEQISEFSKRVILADANLDKVLSAYNKH

RDKPIREQAENIIHLFTLTNLGAPAAFKYFDTTIDRKQYRSTKEVLDA

TLIHQSITGLYETRIDLSQLGGD

Residues V1134, Q1334, and R1336 of SEQ ID NO: 4279, which can be mutated from D1134, R1334, and T1336 of SEQ ID NO: 4276 to yield a SpVQR Cas9, are underlined and in bold.

Exemplary SpVRER Cas9

(SEQ ID NO: 4280)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD

Residues V1134, R1217, Q1334, and R1336 of SEQ ID NO: 4280, which can be mutated from D1134, G1217, R1334, and T1336 of SEQ ID NO: 4276 to yield a SpVRER Cas9, are underlined and in bold.

The following are exemplary fusion proteins (e.g., base editing proteins) capable of binding to a nucleic acid sequence having a non-canonical (e.g., a non-NGG) PAM sequence:

Exemplary SaBE3 (rAPOBEC1-XTEN-SaCas9n-UGI-NLS)

(SEQ ID NO: 4281)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPES<u>KRNYI</u>

<u>LGLDIGITSVGYGIIDYETRDVIDAGVRLFKEANVENNEGRRSKRGARRL</u>

<u>KRRRRHRIQRVKKLLFDYNLLTDHSELSGINPYEARVKGLSQKLSEEEFS</u>

AALLHLAKRRGVHNVNEVEEDTGNELSTKEQISRNSKALEEKYVAELQLE
RLKKDGEVRGSINRFKTSDYVKEAKQLLKVQKAYHQLDQSFIDTYIDLLE
TRRTYYEGPGEGSPFGWKDIKEWYEMLMGHCTYFPEELRSVKYAYNADLY
NALNDLNNLVITRDENEKLEYYEKFQIIENVFKQKKKPTLKQIAKEILVN
EEDIKGYRVTSTGKPEFTNLKVYHDIKDITARKEIIENAELLDQIAKILT
IYQSSEDIQEELTNLNSELTQEEIEQISNLKGYTGTHNLSLKAINLILDE
LWHTNDNQIAIFNRLKLVPKKVDLSQQKEIPTTLVDDFILSPVVKRSFIQ
SIKVINAIIKKYGLPNDIIIELAREKNSKDAQKMINEMQKRNRQTNERIE
EIIRTTGKENAKYLIEKIKLHDMQEGKCLYSLEAIPLEDLLNNPFNYEVD
HIIPRSVSFDNSFNNKVLVKQEEASKKGNRTPFQYLSSSDSKISYETFKK
HILNLAKGKGRISKTKKEYLLEERDINRFSVQKDFINRNLVDTRYATRGL
MNLLRSYFRVNNLDVKVKSINGGFTSFLRRKWKFKKERNKGYKHHAEDAL
IIANADFIFKEWKKLDKAKKVMENQMFEEKQAESMPEIETEQEYKEIFIT
PHQIKHIKDFKDYKYSHRVDKKPNRELINDTLYSTRKDDKGNTLIVNNLN
GLYDKDNDKLKKLINKSPEKLLMYHHDPQTYQKLKLIMEQYGDEKNPLYK
YYEETGNYLTKYSKKDNGPVIKKIKYYGNKLNAHLDITDDYPNSRNKVVK
LSLKPYRFDVYLDNGVYKFVTVKNLDVIKKENYYEVNSKCYEEAKKLKKI
SNQAEFIASFYNNDLIKINGELYRVIGVNNDLLNRIEVNMIDITYREYLE
NMNDKRPPRIIKTIASKTQSIKKYSTDILGNLYEVKSKKHPQIIKKGSGG
STNLSDIIEKETGKQLVIQESILMLPEEVEEVIGNKPESDILVHTAYDES
TDENVMLLTSDAPEYKPWALVIQDSNGENKIKMLSGGSPKKKRKV

Exemplary SaKKH-BE3 (rAPOBEC1-XTEN-SaCas9n-UGI-NLS)

(SEQ ID NO: 4282)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESKRNYI
LGLDIGITSVGYGIIDYETRDVIDAGVRLFKEANVENNEGRRSKRGARRL
KRRRRHRIQRVKKLLFDYNLLTDHSELSGINPYEARVKGLSQKLSEEEFS
AALLHLAKRRGVHNVNEVEEDTGNELSTKEQISRNSKALEEKYVAELQLE
RLKKDGEVRGSINRFKTSDYVKEAKQLLKVQKAYHQLDQSFIDTYIDLLE
TRRTYYEGPGEGSPFGWKDIKEWYEMLMGHCTYFPEELRSVKYAYNADLY
NALNDLNNLVITRDENEKLEYYEKFQIIENVFKQKKKPTLKQIAKEILVN
EEDIKGYRVTSTGKPEFTNLKVYHDIKDITARKEIIENAELLDQIAKILT
IYQSSEDIQEELTNLNSELTQEEIEQISNLKGYTGTHNLSLKAINLILDE
LWHTNDNQIAIFNRLKLVPKKVDLSQQKEIPTTLVDDFILSPVVKRSFIQ
SIKVINAIIKKYGLPNDIIIELAREKNSKDAQKMINEMQKRNRQTNERIE
EIIRTTGKENAKYLIEKIKLHDMQEGKCLYSLEAIPLEDLLNNPFNYEVD
HIIPRSVSFDNSFNNKVLVKQEEASKKGNRTPFQYLSSSDSKISYETFKK
HILNLAKGKGRISKTKKEYLLEERDINRFSVQKDFINRNLVDTRYATRGL
MNLLRSYFRVNNLDVKVKSINGGFTSFLRRKWKFKKERNKGYKHHAEDAL
IIANADFIFKEWKKLDKAKKVMENQMFEEKQAESMPEIETEQEYKEIFIT
PHQIKHIKDFKDYKYSHRVDKKPNRKLINDTLYSTRKDDKGNTLIVNNLN
GLYDKDNDKLKKLINKSPEKLLMYHHDPQTYQKLKLIMEQYGDEKNPLYK
YYEETGNYLTKYSKKDNGPVIKKIKYYGNKLNAHLDITDDYPNSRNKVVK
LSLKPYRFDVYLDNGVYKFVTVKNLDVIKKENYYEVNSKCYEEAKKLKKI
SNQAEFIASFYKNDLIKINGELYRVIGVNNDLLNRIEVNMIDITYREYLE
NMNDKRPPHIIKTIASKTQSIKKYSTDILGNLYEVKSKKHPQIIKKGSGG
STNLSDIIEKETGKQLVIQESILMLPEEVEEVIGNKPESDILVHTAYDES
TDENVMLLTSDAPEYKPWALVIQDSNGENKIKMLSGGSPKKKRKV

Exemplary EOR-BE3 (rAPOBEC1-XTEN-Cas9n-UGI-NLS)

(SEQ ID NO: 4283)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVETSGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS
KESILPKRNSDKLIARKKDWDPKKYGGF*E*SPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRK*QYR*STKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV

VQR-BE3 (rAPOBEC1-XTEN-Cas9n-UGI-NLS)

(SEQ ID NO: 4284)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVETSGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFVSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRK*QYR*STKEVLDATLIHQSITGLY
ETRIDLSQLGGDSGGSTNLSDIIEKETGKQLVIQESILMLPEEVEEVIGN
KPESDILVHTAYDESTDENVMLLTSDAPEYKPWALVIQDSNGENKIKMLS
GGSPKKKRKV

VRER-BE3 (rAPOBEC1-XTEN-Cas9n-UGI-NLS)

(SEQ ID NO: 4285)
MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGF*V*SPTVAYSVLVVAKVEKGKSKK
LKSVKELLGITIMERSSFEKNPIDFLEAKGYKEVKKDLIIKLPKYSLFEL
ENGRKRMLASARELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRK*EYR*STKEVLDATLIHQSITGLY

```
ETRIDLSQLGGDSGGSTNLSDIIEKETGKQLVIQESILMLPEEVEEVIGN

KPESDILVHTAYDESTDENVMLLTSDAPEYKPWALVIQDSNGENKIKMLS

GGSPKKKRKV
```

High Fidelity Base Editors

Some aspects of the disclosure provide Cas9 fusion proteins (e.g., any of the fusion proteins provided herein) comprising a Cas9 domain that has high fidelity. Additional aspects of the disclosure provide Cas9 fusion proteins (e.g., any of the fusion proteins provided herein) comprising a Cas9 domain with decreased electrostatic interactions between the Cas9 domain and a sugar-phosphate backbone of a DNA, as compared to a wild-type Cas9 domain. In some embodiments, a Cas9 domain (e.g., a wild type Cas9 domain) comprises one or more mutations that decreases the association between the Cas9 domain and a sugar-phosphate backbone of a DNA. In some embodiments, any of the Cas9 fusion proteins provided herein comprise one or more of a N497X, a R661X, a Q695X, and/or a Q926X mutation of the amino acid sequence provided in SEQ ID NO: 10, or a corresponding mutation in any of the amino acid sequences provided in SEQ ID NOs: 11-260, wherein X is any amino acid. In some embodiments, any of the Cas9 fusion proteins provided herein comprise one or more of a N497A, a R661A, a Q695A, and/or a Q926A mutation of the amino acid sequence provided in SEQ ID NO: 10, or a corresponding mutation in any of the amino acid sequences provided in SEQ ID NOs: 11-260. In some embodiments, the Cas9 domain comprises a D10A mutation of the amino acid sequence provided in SEQ ID NO: 10, or a corresponding mutation in any of the amino acid sequences provided in SEQ ID NOs: 11-260. In some embodiments, the Cas9 domain (e.g., of any of the fusion proteins provided herein) comprises the amino acid sequence as set forth in SEQ ID NO: 325. In some embodiments, the fusion protein comprises the amino acid sequence as set forth in SEQ ID NO: 285. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that the base editors provided herein, for example base editor 2 (BE2) or base editor 3 (BE3), may be converted into high fidelity base editors by modifying the Cas9 domain as described herein to generate high fidelity base editors, for example high fidelity base editor 2 (HF-BE2) or high fidelity base editor 3 (HF-BE3). In some embodiments, base editor 2 (BE2) comprises a deaminase domain, a dCas9, and a UGI domain. In some embodiments, base editor 3 (BE3) comprises a deaminase domain an nCas9 domain and a UGI domain.

Cas9 Domain where Mutations Relative to Cas9 of SEQ ID NO: 10 are Shown in Bold and Underlines

```
                                     (SEQ ID NO: 325)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

HF-BE3

```
                                    (SEQ ID NO: 5808)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYS

IGLAIGTNSVGWAVITDEYKVPSKKFKVLGNTDRHSIKKNLIGALLFDSG

ETALATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSK

NGYAGYIDGGASQLEFYKFIKPILEKMDGTEELLVKLNREDLLRKQRTFD
```

-continued

NGSIPHQIHLGELHAILRRQEDFYPFLKDNREKIEKILTFRIPYYVGPLA

RGNSRFAWMTRKSEETITPWNFEEVVDKGASAQSFIERMTAFDKNLPNEK

VLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRY

TGWGALSRKLINGIRDKQSGKTILDFLKSDGFANRNFMALIHDDSLTFKE

DIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQL

QNEKLYLYYLONGRDMYVDQELDINRLSDYDVDHIVPQSFLKDDSIDNKV

LTRSDKNRGKSDNVPSEEVVKKMKNYWRQLLNAKLITQRKFDNLTKAERG

GLSELDKAGFIKRQLVETRAITKHVAQILDSRMNTKYDENDKLIREVKVI

TLKSKLVSDFRKDFQFYKVREINNYHHAHDAYLNAVVGTALIKKYPKLES

EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS

KESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLY

ETRIDLSQLGGD

Cas9 Fusion Proteins

Any of the Cas9 domains (e.g., a nuclease active Cas9 protein, a nuclease-inactive dCas9 protein, or a Cas9 nickase protein) disclosed herein may be fused to a second protein, thus fusion proteins provided herein comprise a Cas9 domain as provided herein and a second protein, or a "fusion partner". In some embodiments, the second protein is fused to the N-terminus of the Cas9 domain. However, in other embodiments, the second protein is fused to the C-terminus of the Cas9 domain. In some embodiments, the second protein that is fused to the Cas9 domain is a nucleic acid editing domain. In some embodiments, the Cas9 domain and the nucleic acid editing domain are fused via a linker, while in other embodiments the Cas9 domain and the nucleic acid editing domain are fused directly to one another. In some embodiments, the linker comprises (GGGS)$_n$ (SEQ ID NO: 265), (GGGGS)$_n$ (SEQ ID NO: 5), (G)$_n$, (EAAAK)$_n$ (SEQ ID NO: 6), (GGS)$_n$, (SGGS)$_n$ (SEQ ID NO: 4288), SGSETPGTSESATPES (SEQ ID NO: 7), or (XP)$_n$ motif, or a combination of any of these, wherein n is independently an integer between 1 and 30, and wherein X is any amino acid. In some embodiments, the linker comprises a (GGS)$_n$ motif, wherein n is 1, 3, or 7. In some embodiments, the linker comprises a (GGS)$_n$ motif, wherein n is 1, 2, 3, 4, 5, 6, 7, 8, 9, 10, 11, 12, 13, 14, or 15. In some embodiments, the linker comprises an amino acid sequence of SGSETPGTSESATPES (SEQ ID NO: 7), also referred to as the XTEN linker in the Examples). The length of the linker can influence the base to be edited, as illustrated in the Examples. For example, a linker of 3-amino-acid long (e.g., (GGS)$_1$) may give a 2-5, 2-4, 2-3, 3-4 base editing window relative to the PAM sequence, while a 9-amino-acid linker (e.g., (GGS)$_3$ (SEQ ID NO: 596)) may give a 2-6, 2-5, 2-4, 2-3, 3-6, 3-5, 3-4, 4-6, 4-5, 5-6 base editing window relative to the PAM sequence. A 16-amino-acid linker (e.g., the XTEN linker) may give a 2-7, 2-6, 2-5, 2-4, 2-3, 3-7, 3-6, 3-5, 3-4, 4-7, 4-6, 4-5, 5-7, 5-6, 6-7 base window relative to the PAM sequence with exceptionally strong activity, and a 21-amino-acid linker (e.g., (GGS)$_7$ (SEQ ID NO: 597)) may give a 3-8, 3-7, 3-6, 3-5, 3-4, 4-8, 4-7, 4-6, 4-5, 5-8, 5-7, 5-6, 6-8, 6-7, 7-8 base editing window relative to the PAM sequence. The novel finding that varying linker length may allow the dCas9 fusion proteins of the disclosure to edit nucleobases different distances from the PAM sequence affords siginicant clinical importance, since a PAM sequence may be of varying distance to the disease-causing mutation to be corrected in a gene. It is to be understood that the linker lengths described as examples here are not meant to be limiting.

In some embodiments, the second protein comprises an enzymatic domain. In some embodiments, the enzymatic domain is a nucleic acid editing domain. Such a nucleic acid editing domain may be, without limitation, a nuclease, a nickase, a recombinase, a deaminase, a methyltransferase, a methylase, an acetylase, or an acetyltransferase. Non-limiting exemplary binding domains that may be used in accordance with this disclosure include transcriptional activator domains and transcriptional repressor domains.

Deaminase Domains

In some embodiments, second protein comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deminase is a human APOBEC3G (SEQ ID NO: 275). In some embodiments, the deaminase is a fragment of the human APOBEC3G (SEQ ID NO: 5740). In some embodiments, the deaminase is a human APOBEC3G variant comprising a D316R_D317R mutation (SEQ ID NO: 5739). In some embodiments, the deaminase is a fragment of the human APOBEC3G and comprising mutations corresponding to the D316R_D317R mutations in SEQ ID NO: 275 (SEQ ID NO: 5741).

In some embodiments, the nucleic acid editing domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 266-284, 607-610, 5724-5736, or 5738-5741. In some embodiments, the nucleic acid editing domain comprises the amino acid sequence of any one of SEQ ID NOs: 266-284, 607-610, 5724-5736, or 5738-5741.

Deaminase Domains that Modulate the Editing Window of Base Editors

Some aspects of the disclosure are based on the recognition that modulating the deaminase domain catalytic activity of any of the fusion proteins provided herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deaminataion window may prevent unwanted deamination of residues adjacent of specific target residues, which may decrease or prevent off-target effects.

In some embodiments, any of the fusion proteins provided herein comprise a deaminase domain (e.g., a cytidine deaminase domain) that has reduced catalytic deaminase activity. In some embodiments, any of the fusion proteins provided herein comprise a deaminase domain (e.g., a cytidine deaminase domain) that has a reduced catalytic deaminase activity as compared to an appropriate control. For example, the appropriate control may be the deaminase activity of the deaminase prior to introducing one or more mutations into the deaminase. In other embodiments, the appropriate control may be a wild-type deaminase. In some embodiments, the appropriate control is a wild-type apolipoprotein B mRNA-editing complex (APOBEC) family deaminase. In some embodiments, the appropriate control is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, or an APOBEC3H deaminase. In some embodiments, the appropriate control is an activation induced deaminase (AID). In some embodiments, the appropriate control is a cytidine deaminase 1 from *Petromyzon marinus* (pmCDA1). In some embodiments, the deaminase domain may be a deaminase domain that has at least 1%, at least 5%, at least 15%, at least 20%, at least 25%, at least 30%, at least 40%, at least 50%, at least 60%, at least 70%, at least 80%, at least 90%, or at least 95% less catalytic deaminase activity as compared to an appropriate control.

In some embodiments, any of the fusion proteins provided herein comprise an APOBEC deaminase comprising one or more mutations selected from the group consisting of H121X, H122X, R126X, R126X, R118X, W90X, W90X, and R132X of rAPOBEC1 (SEQ ID NO: 284), or one or more corresponding mutations in another APOBEC deaminase, wherein X is any amino acid. In some embodiments, any of the fusion proteins provided herein comprise an APOBEC deaminase comprising one or more mutations selected from the group consisting of H121R, H122R, R126A, R126E, R118A, W90A, W90Y, and R132E of rAPOBEC1 (SEQ ID NO: 284), or one or more corresponding mutations in another APOBEC deaminase.

In some embodiments, any of the fusion proteins provided herein comprise an APOBEC deaminase comprising one or more mutations selected from the group consisting of D316X, D317X, R320X, R320X, R313X, W285X, W285X, R326X of hAPOBEC3G (SEQ ID NO: 275), or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G (SEQ ID NO: 275), or one or more corresponding mutations in another APOBEC deaminase.

In some embodiments, any of the fusion proteins provided herein comprise an APOBEC deaminase comprising a H121R and a H122R mutation of rAPOBEC1 (SEQ ID NO: 284), or one or more corresponding mutations in another APOBEC deaminase. In some embodiments, any of the fusion proteins provided herein comprise an APOBEC deaminase comprising a R126A mutation of rAPOBEC1 (SEQ ID NO: 284), or one or more corresponding mutations in another APOBEC deaminase. In some embodiments, any of the fusion proteins provided herein comprise an APOBEC deaminase comprising a R126E mutation of rAPOBEC1 (SEQ ID NO: 284), or one or more corresponding mutations in another APOBEC deaminase. In some embodiments, any of the fusion proteins provided herein comprise an APOBEC deaminase comprising a R118A mutation of rAPOBEC1 (SEQ ID NO: 284), or one or more corresponding mutations in another APOBEC deaminase. In some embodiments, any of the fusion proteins provided herein comprise an APOBEC deaminase comprising a W90A mutation of rAPOBEC1 (SEQ ID NO: 284), or one or more corresponding mutations in another APOBEC deaminase. In some embodiments, any of the fusion proteins provided herein comprise an APOBEC deaminase comprising a W90Y mutation of rAPOBEC1 (SEQ ID NO: 284), or one or more corresponding mutations in another APOBEC deaminase. In some embodiments, any of the fusion proteins provided herein comprise an APOBEC deaminase comprising a R132E mutation of rAPOBEC1 (SEQ ID NO: 284), or one or more corresponding mutations in another APOBEC deaminase. In some embodiments, any of the fusion proteins provided herein comprise an APOBEC deaminase comprising a W90Y and a R126E mutation of rAPOBEC1 (SEQ ID NO: 284), or one or more corresponding mutations in another APOBEC deaminase. In some embodiments, any of the fusion proteins provided herein comprise an APOBEC deaminase comprising a R126E and a R132E mutation of rAPOBEC1 (SEQ ID NO: 284), or one or more corresponding mutations in another APOBEC deaminase. In some embodiments, any of the fusion proteins provided herein comprise an APOBEC deaminase comprising a W90Y and a R132E mutation of rAPOBEC1 (SEQ ID NO: 284), or one or more corresponding mutations in another APOBEC deaminase. In some embodiments, any of the fusion proteins provided herein comprise an APOBEC deaminase comprising a W90Y, R126E, and R132E mutation of rAPOBEC1 (SEQ ID NO: 284), or one or more corresponding mutations in another APOBEC deaminase.

In some embodiments, any of the fusion proteins provided herein comprise an APOBEC deaminase comprising a D316R and a D317R mutation of hAPOBEC3G (SEQ ID NO: 275), or one or more corresponding mutations in another APOBEC deaminase. In some embodiments, any of the fusion proteins provided herein comprise an APOBEC deaminase comprising a R320A mutation of hAPOBEC3G (SEQ ID NO: 275), or one or more corresponding mutations in another APOBEC deaminase. In some embodiments, any of the fusion proteins provided herein comprise an APOBEC deaminase comprising a R320E mutation of hAPOBEC3G (SEQ ID NO: 275), or one or more corresponding mutations in another APOBEC deaminase. In some embodiments, any of the fusion proteins provided herein comprise an APOBEC deaminase comprising a R313A mutation of hAPOBEC3G (SEQ ID NO: 275), or one or more corresponding mutations in another APOBEC deaminase. In some embodiments, any of the fusion proteins provided herein comprise an APOBEC deaminase comprising a W285A mutation of hAPOBEC3G (SEQ ID NO: 275), or one or more corresponding mutations in another APOBEC deaminase. In some embodiments, any of the fusion proteins provided herein comprise an APOBEC deaminase comprising a W285Y mutation of hAPOBEC3G (SEQ ID NO: 275), or one or more corresponding mutations in another APOBEC deaminase. In some embodiments, any of the fusion proteins provided herein comprise an APOBEC deaminase comprising a R326E mutation of hAPOBEC3G (SEQ ID NO: 275), or one or more corresponding mutations in another APOBEC deaminase. In some embodiments, any of the fusion proteins provided herein comprise an APOBEC deaminase comprising a W285Y and a R320E mutation of hAPOBEC3G (SEQ ID NO: 275), or one or more corresponding mutations in another APOBEC deaminase. In some embodiments, any of the fusion proteins provided herein comprise an APOBEC deaminase comprising a R320E and a R326E mutation of hAPOBEC3G (SEQ ID NO: 275), or one or more corresponding mutations in another APOBEC deaminase. In some embodiments, any of the fusion proteins provided herein comprise an APOBEC deaminase comprising a W285Y and a R326E mutation of hAPOBEC3G (SEQ ID NO: 275), or one or more corresponding mutations in another APOBEC deaminase. In some embodiments, any of the fusion proteins provided herein comprise an APOBEC deaminase comprising a W285Y, R320E, and R326E mutation of hAPOBEC3G (SEQ ID NO: 275), or one or more corresponding mutations in another APOBEC deaminase.

Some aspects of this disclosure provide fusion proteins comprising (i) a nuclease-inactive Cas9 domain; and (ii) a nucleic acid editing domain. In some embodiments, a nuclease-inactive Cas9 domain (dCas9), comprises an amino acid sequence that is at least 80%, at least 85%, at least 90%, at least 92%, at least 95%, at least 96%, at least 97%, at least 98%, at least 99%, or at least 99.5% identical to the amino acid sequence of a Cas9 as provided by any one of SEQ ID NOs: 11-260, and comprises mutations that inactivate the nuclease activity of Cas9. Mutations that render the nuclease domains of Cas9 inactive are well-known in the art. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, the dCas9 of this disclosure comprises a D10A mutation of the amino acid sequence provided in SEQ ID NO: 10, or a corresponding mutation in any of the amino acid sequences provided in SEQ ID NOs: 11-260. In some embodiments, the dCas9 of this disclosure comprises a H840A mutation of the amino acid sequence provided in SEQ ID NO: 10, or a corresponding mutation in any of the amino acid sequences provided in SEQ ID NOs: 11-260. In some embodiments, the dCas9 of this disclosure comprises both D10A and H840A mutations of the amino acid sequence provided in SEQ ID NO: 10, or a corresponding mutation in any of the amino acid sequences provided in SEQ ID NOs: 11-260. In some embodiments, the Cas9 further comprises a histidine residue at position 840 of the amino acid sequence provided in SEQ ID NO: 10, or a corresponding mutation in any of the amino acid sequences provided in SEQ ID NOs: 11-260. The presence of the catalytic residue H840 restores the acvitity of the Cas9 to cleave the non-edited strand containing a G opposite the targeted C. Restoration of H840 does not result in the cleavage of the target strand containing the C. In some embodiments, the dCas9 comprises an amino acid sequence of SEQ ID NO: 263. It is to be understood that other mutations that inactivate the nuclease domains of Cas9 may also be included in the dCas9 of this disclosure.

The Cas9 or dCas9 domains comprising the mutations disclosed herein, may be a full-length Cas9, or a fragment thereof. In some embodiments, proteins comprising Cas9, or fragments thereof, are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9, e.g., a Cas9 comprising the amino acid sequence of SEQ ID NO: 10.

Any of the Cas9 fusion proteins of this disclosure may further comprise a nucleic acid editing domain (e.g., an enzyme that is capable of modifying nucleic acid, such as a deaminase). In some embodiments, the nucleic acid editing domain is a DNA-editing domain. In some embodiments, the nucleic acid editing domain has deaminase activity. In some embodiments, the nucleic acid editing domain comprises or consists of a deaminase or deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In some embodiments, the deaminase is an activation-induced cytidine deaminase (AID). Some nucleic-acid editing domains as well as Cas9 fusion proteins including such domains are described in detail herein. Additional suitable nucleic acid editing domains will be apparent to the skilled artisan based on this disclosure and knowledge in the field.

Some aspects of the disclosure provide a fusion protein comprising a Cas9 domain fused to a nucleic acid editing domain, wherein the nucleic acid editing domain is fused to the N-terminus of the Cas9 domain. In some embodiments, the Cas9 domain and the nucleic acid editing-editing domain are fused via a linker. In some embodiments, the linker comprises a $(GGGS)_n$ (SEQ ID NO: 265), a $(GGGGS)_n$ (SEQ ID NO: 5), a $(G)_n$, an $(EAAAK)_n$ (SEQ ID NO: 6), a $(GGS)_n$, $(SGGS)_n$ (SEQ ID NO: 4288), an SGSETPGT-SESATPES (SEQ ID NO: 7) motif (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference), or an (XP)$_n$ motif, or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. In some embodiments, the linker comprises a (GGS)$_n$ motif, wherein n is 1,2, 3, 4, 5, 6, 7, 8, 9, 10, 11, 12, 13, 14 or 15. In some embodiments, the linker comprises a (GGS)$_n$ motif, wherein n is 1, 3, or 7. In some embodiments, the linker comprises the amino acid sequence SGSETPGTSESATPES (SEQ ID NO: 7). Additional suitable linker motifs and linker configurations will be apparent to those of skill in the art. In some embodiments, suitable linker motifs and configurations include those described in Chen et al., Fusion protein linkers: property, design and functionality. *Adv Drug Deliv Rev.* 2013; 65(10):1357-69, the entire contents of which are incorporated herein by reference. Additional suitable linker sequences will be apparent to those of skill in the art based on the instant disclosure. In some embodiments, the general architecture of exemplary Cas9 fusion proteins provided herein comprises the structure:

[NH$_2$]-[nucleic acid editing domain]-[Cas9]-[COOH] or
[NH$_2$]-[nucleic acid editing domain]-[linker]-[Cas9]-[COOH], wherein NH$_2$ is the N-terminus of the fusion protein, and COOH is the C-terminus of the fusion protein.

The fusion proteins of the present disclosure may comprise one or more additional features. For example, in some embodiments, the fusion protein comprises a nuclear localization sequence (NLS). In some embodiments, the NLS of the fusion protein is localized between the nucleic acid editing domain and the Cas9 domain. In some embodiments, the NLS of the fusion protein is localized C-terminal to the Cas9 domain.

Other exemplary features that may be present are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

In some embodiments, the nucleic acid editing domain is a deaminase. For example, in some embodiments, the general architecture of exemplary Cas9 fusion proteins with a deaminase domain comprises the structure:

[NH$_2$]-[NLS]-[deaminase]-[Cas9]-[COOH],
[NH$_2$]-[Cas9]-[deaminase]-[COOH],
[NH$_2$]-[deaminase]-[Cas9]-[COOH], or
[NH$_2$]-[deaminase]-[Cas9]-[NLS]-[COOH]

wherein NLS is a nuclear localization sequence, NH$_2$ is the N-terminus of the fusion protein, and COOH is the C-terminus of the fusion protein. Nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 741) or MDSLLMNRRKFLYQFKNVRWAKGR-RETYLC (SEQ ID NO: 742). In some embodiments, a linker is inserted between the Cas9 and the deaminase. In some embodiments, the NLS is located C-terminal of the Cas9 domain. In some embodiments, the NLS is located N-terminal of the Cas9 domain. In some embodiments, the NLS is located between the deaminase and the Cas9 domain. In some embodiments, the NLS is located N-terminal of the deaminase domain. In some embodiments, the NLS is located C-terminal of the deaminase domain.

One exemplary suitable type of nucleic acid editing domain is a cytidine deaminase, for example, of the APOBEC family. The apolipoprotein B mRNA-editing complex (APOBEC) family of cytidine deaminase enzymes encompasses eleven proteins that serve to initiate mutagenesis in a controlled and beneficial manner.[29] One family member, activation-induced cytidine deaminase (AID), is responsible for the maturation of antibodies by converting cytosines in ssDNA to uracils in a transcription-dependent, strand-biased fashion.[30] The apolipoprotein B editing complex 3 (APOBEC3) enzyme provides protection to human cells against a certain HIV-1 strain via the deamination of cytosines in reverse-transcribed viral ssDNA.[31] These proteins all require a Zn$^{2+}$-coordinating motif (His-X-Glu-X$_{23-26}$-Pro-Cys-X$_{2-4}$-Cys; SEQ ID NO: 598) and bound water molecule for catalytic activity. The Glu residue acts to activate the water molecule to a zinc hydroxide for nucleophilic attack in the deamination reaction. Each family member preferentially deaminates at its own particular "hotspot", ranging from WRC (W is A or T, R is A or G) for hAID, to TTC for hAPOBEC3F.[32] A recent crystal structure of the catalytic domain of APOBEC3G revealed a secondary structure comprised of a five-stranded β-sheet core flanked by six α-helices, which is believed to be conserved across the entire family.[33] The active center loops have been shown to be responsible for both ssDNA binding and in determining "hotspot" identity.[34] Overexpression of these enzymes has been linked to genomic instability and cancer, thus highlighting the importance of sequence-specific targeting.[35]

Some aspects of this disclosure relate to the recognition that the activity of cytidine deaminase enzymes such as APOBEC enzymes can be directed to a specific site in genomic DNA. Without wishing to be bound by any particular theory, advantages of using Cas9 as a recognition agent include (1) the sequence specificity of Cas9 can be easily altered by simply changing the sgRNA sequence; and (2) Cas9 binds to its target sequence by denaturing the dsDNA, resulting in a stretch of DNA that is single-stranded and therefore a viable substrate for the deaminase. It should be understood that other catalytic domains, or catalytic domains from other deaminases, can also be used to generate fusion proteins with Cas9, and that the disclosure is not limited in this regard.

Figure 3:
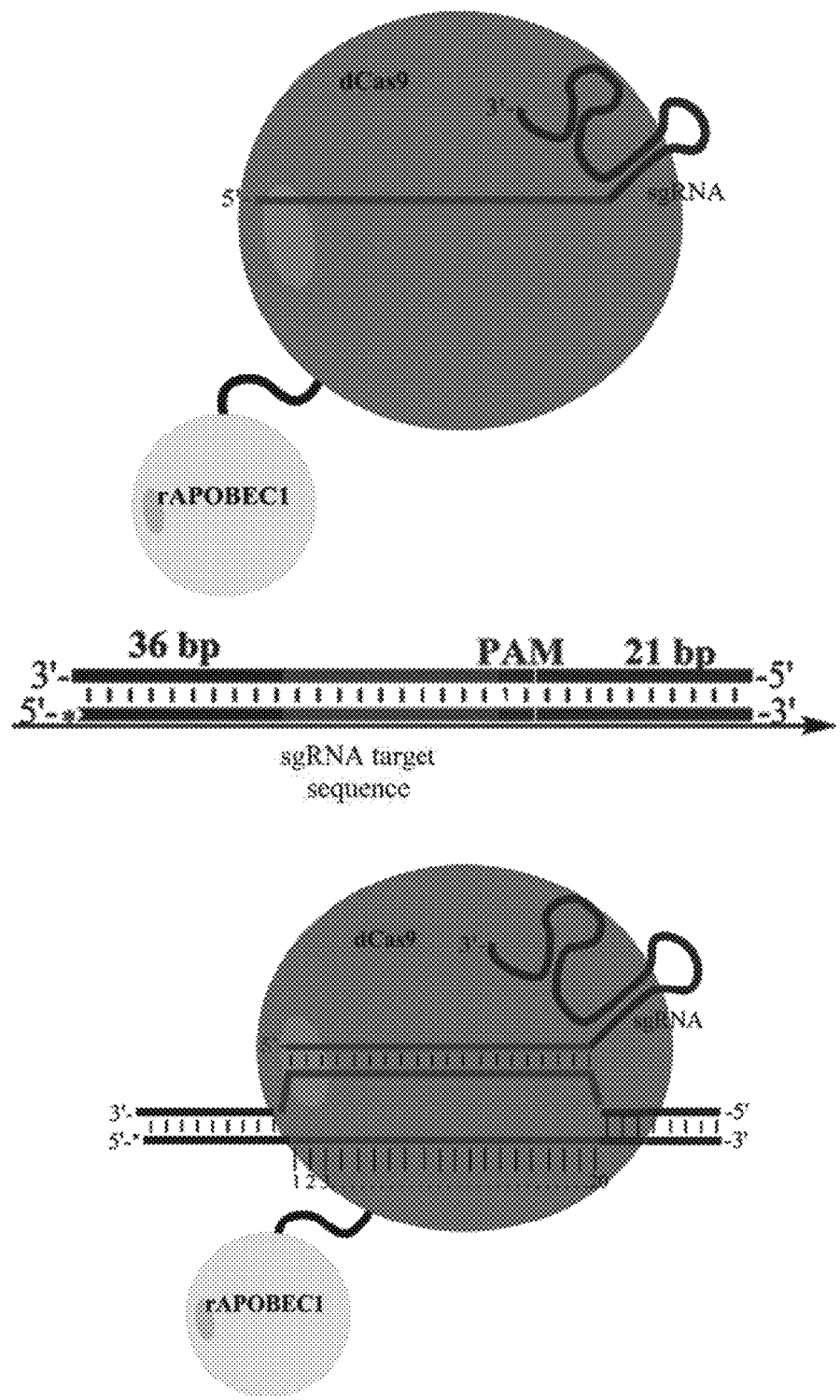
FIG. 3 illustrates double stranded DNA substrate binding by Cas9:deaminase:sgRNA complexes.

Some aspects of this disclosure are based on the recognition that Cas9:deaminase fusion proteins can efficiently deaminate nucleotides at positions 3-11 according to the numbering scheme in FIG. 3. In view of the results provided herein regarding the nucleotides that can be targeted by Cas9:deaminase fusion proteins, a person of skill in the art will be able to design suitable guide RNAs to target the fusion proteins to a target sequence that comprises a nucleotide to be deaminated.

In some embodiments, the deaminase domain and the Cas9 domain are fused to each other via a linker. Various linker lengths and flexibilities between the deaminase domain (e.g., AID) and the Cas9 domain can be employed (e.g., ranging from very flexible linkers of the form (GGGGS)$_n$ (SEQ ID NO: 5), (GGS)$_n$, and (G)$_n$ to more rigid linkers of the form (EAAAK)$_n$ (SEQ ID NO: 6), (SGGS)$_n$ (SEQ ID NO: 4288), SGSETPGTSESATPES (SEQ ID NO: 7) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP)$_n^{36}$ in order to achieve the optimal length for deaminase activity for the specific application. In some embodiments, the linker comprises a (GGS)$_n$ motif, wherein n is 1, 3, or 7. In some embodiments, the linker comprises a (an SGSETPGTSESATPES (SEQ ID NO: 7) motif.

Some exemplary suitable nucleic-acid editing domains, e.g., deaminases and deaminase domains, that can be fused to Cas9 domains according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:

(SEQ ID NO: 266)
MDSLLMNRRKFLYQFKNVRWAKGRRETYLCYVVKRRDSATSFSLDFGY
LRNKNGCHVELLFLRYISDWDLDPGRCYRVTWFTSWSPCYDCARHVAD
FLRGNPNLSLRIFTARLYFCEDRKAEPEGLRRLHRAGVQIAIMTFKDY
FYCWNTFVENHERTFKAWEGLHENSVRSRQLRRTLLPLYEVDDLRDA
FRTLGL (underline: nuclear localization sequence; double underline: nuclear export signal)

Mouse AID:

(SEQ ID NO: 267)
MDSLLMKQKKFLYHFKNVRWAKGRHETYLCYVVKRRDSATSCSLDFGH
LRNKSGCHVELLFLRYISDWDLDPGRCYRVTWFTSWSPCYDCARHVAE
FLRWNPNLSLRIFTARLYFCEDRKAEPEGLRRLHRAGVQIGIMTFKDY
FYCWNTFVENRERTFKAWEGLHENSVRLTRQLRRILLPLYEVDDLRDA
FRMLGF (underline: nuclear localization sequence; double underline: nuclear export signal)

Dog AID:

(SEQ ID NO: 268)
MDSLLMKQRKFLYHFKNVRWAKGRHETYLCYVVKRRDSATSFSLDFGH
LRNKSGCHVELLFLRYISDWDLDPGRCYRVTWFTSWSPCYDCARHVAD
FLRGYPNLSLRIFAARLYFCEDRKAEPEGLRRLHRAGVQIAIMTFKDY
FYCWNTFVENREKTFKAWEGLHENSVRLSRQLRRILLPLYEVDDLRDA
FRTLGL (underline: nuclear localization sequence; double underline: nuclear export signal)

Bovine AID:

(SEQ ID NO: 269)
MDSLLKKQRQFLYQFKNVRWAKGRHETYLCYVVKRRDSPTSFSLDFGH
LRNKAGCHVELLFLRYISDWDLDPGRCYRVTWFTSWSPCYDCARHVAD
FLRGYPNLSLRIFTARLYFCDKERKAEPEGLRRLHRAGVQIAIMTFKD
YFYCWNTFVENHERTFKAWEGLHENSVRKSRQLRRILLPLYEVDDLRD
AFRTLGL (underline: nuclear localization sequence; double underline: nuclear export signal)

Rat AID (SEQ ID NO: 5725)
MAVGSKPKAALVGPHWERERIWCFLCSTGLGTQQTGQTSRWLRPAATQ
DPVSPPRSLLMKQRKFLYHFKNVRWAKGRHETYLCYVVKRRDSATSFS
LDFGYLRNKSGCHVELLFLRYISDWDLDPGRCYRVTWFTSWSPCYDCA
RHVADFLRGNPNLSLRIFTARLTGWGALPAGLMSPARPSDYFYCWNTF
VENHERTFKAWEGLHENSVRLSRRLRRILLPLYEVDDLRDAFRTLGL (underline: nuclear localization sequence; double underline: nuclear export signal)

Mouse APOBEC-3:

(SEQ ID NO: 270)
MGPFCLGCSHRKCYSPIRNLISQETFKFHFKNLGYAKGRKDTFLCYEV
TRKDCDSPVSLHHGVFKNKDNI*HAEICFLYWFHDKVLKVLSPREEFKI
TWYMSWSPCFEC*AEQIVRFLATHHNLSLDIFSSRLYNVQDPETQQNLC
RLVQEGAQVAAMDLYEFKKCWKKFVDNGGRRFRPWKRLLTNFRYQDSK
LQEILRPCYIPVPSSSSSTLSNICLTKGLPETRFCVEGRRMDPLSEEE
FYSQFYNQRVKHLCYYHRMKPYLCYQLEQFNGQAPLKGCLLSEKGKQ*H
AEILFLDKIRSMELSQVTITCYLTWSPCPNCAWQLAAFKRDRPDLILH
IYTSRLYFHWKRPFQKGLCSLWQSGILVDVMDLPQFTDCWTNFVNPKR
PFWPWKGLEIISRRTQRRLRRIKESWGLQDLVNDFGNLQLGPPMS*

(italic: nucleic acid editing domain)

Rat APOBEC-3:

(SEQ ID NO: 271)
MGPFCLGCSHRKCYSPIRNLISQETFKFHFKNLRYAIDRKDTFLCYEV
TRKDCDSPVSLHHGVFKNKDNI*HAEICFLYWFHDKVLKVLSPREEFKI
TWYMSWSPCFEC*AEQVLRFLATHHNLSLDIFSSRLYNIRDPENQQNLC
RLVQEGAQVAAMDLYEFKKCWKKFVDNGGRRFRPWKKLLTNFRYQDSK
LQEILRPCYIPVPSSSSSTLSNICLTKGLPETRFCVERRRVHLLSEEE
FYSQFYNQRVKHLCYYHGVKPYLCYQLEQFNGQAPLKGCLLSEKGKQ*H
AEILFLDKIRSMELSQVIITCYLTWSPCPNCAWQLAAFKRDRPDLILH
IYTSRLYFHWKRPFQKGLCSLWQSGILVDVMDLPQFTDCWTNFVNPKR
PFWPWKGLEIISRRTQRRLHRIKESWGLQDLVNDFGNLQLGPPMS*

(italic: nucleic acid editing domain)

Rhesus macaque APOBEC-3G:

(SEQ ID NO: 272)
MVEPMDPRTFVSNFNNRPILSGLNTVWLCCEVKTKDPSGPPLDAKIFQ

GKVYSKAKYHPEMRFLRWFHKWRQLHHDQEYKVTWYVSWSPCTRCANS

VATFLAKDPKYTLTIFVARLYYFWKPDYQQALRILCQKRGGPHATMKI

MNYNEFQDCWNKFVDGRGKPFKPRNNLPKHYTLLQATLGELLRHLMDP

GTFTSNFNNKPWVSGQHETYLCYKVERLHNDTWVPLNQHRGFLRNQAP

NIHGFPKGRHAELCFLDLIPFWKLDGQQYRVTCFTSWSPCFSCAQEMA

KFISNNEHVSLCIFAARIYDDQGRYQEGLRALHRDGAKIAMMNYSEFE

YCWDTFVDRQGRPFQPWDGLDEHSQALSGRLRAI (italic: nucleic acid editing domain; underline: cytoplasmic localization signal)
Chimpanzee APOBEC-3G:

(SEQ ID NO: 273)
MKPHFRNPVERMYQDTFSDNFYNRPILSHRNTVWLCYEVKTKGPSRPP

LDAKIFRGQVYSKLKYHPEMRFFHWFSKWRKLHRDQEYEVTWYISWSP

CTKCTRDVATFLAEDPKVTLTIFVARLYYFWDPDYQEALRSLCQKRDG

PRATMKIMNYDEFQHCWSKFVYSQRELFEPWNNLPKYYILLHIMLGEI

LRHSMDPPTFTSNFNNELWVRGRHETYLCYEVERLHNDTWVLLNQRRG

FLCNQAPHKHGFLEGRHAELCFLDVIPFWKLDLHQDYRVTCFTSWSPC

FSCAQEMAKFISNNKHVSLCIFAARIYDDQGRCQEGLRTLAKAGAKIS

IMTYSEFKHCWDTFVDHQGCPFQPWDGLEEHSQALSGRLRAILQNGN (italic: nucleic acid editing domain; underline: cytoplasmic localization signal)
Green monkey APOBEC-3G:

(SEQ ID NO: 274)
MNPQIRNMVEQMEPDIFVYYFNNRPILSGRNTVWLCYEVKTKDPSGPP

LDANIFQGKLYPEAKDHPEMKFLHWFRKWRQLHRDQEYEVTWYVSWSP

CTRCANSVATFLAEDPKVTLTIFVARLYYFWKPDYQQALRILCQERGG

PHATMKIMNYNEFQHCWNEFVDGQGKPFKPRKNLPKHYTLLHATLGEL

LRHVMDPGTFTSNFNNKPWVSGQRETYLCYKVERSHNDTWVLLNQHRG

FLRNQAPDRHGFPKGRHAELCFLDLIPFWKLDDQQYRVTCFTSWSPCF

SCAQKMAKFISNNKHVSLCIFAARIYDDQGRCQEGLRTLHRDGAKIAV

MNYSEFEYCWDTFVDRQGRPFQPWDGLDEHSQALSGRLRAI (italic: nucleic acid editing domain; underline: cytoplasmic localization signal)
Human APOBEC-3G:

(SEQ ID NO: 275)
MKPHFRNTVERMYRDTFSYNFYNRPILSRRNTVWLCYEVKTKGPSRPPLD

AKIFRGQVYSELKYHPEMRFFHWFSKWRKLHRDQEYEVTWYISWSPCTKC

TRDMATFLAEDPKVTLTIFVARLYYFWDPDYQEALRSLCQKRDGPRATMK

IMNYDEFQHCWSKFVYSQRELFEPWNNLPKYYILLHIMLGEILRHSMDPP

TFTFNFNNEPWVRGRHETYLCYEVERMHNDTWVLLNQRRGFLCNQAPHKH

GFLEGRHAELCFLDVIPFWKLDLDQDYRVTCFTSWSPCFSCAQEMAKFIS

KNKHVSLCIFTARIYDDQGRCQEGLRTLAEAGAKISIMTYSEFKHCWDTF

VDHQGCPFQPWDGLDEHSQDLSGRLRAILQNQEN (italic: nucleic acid editing domain; underline: cytoplasmic localization signal)
Human APOBEC-3F:

(SEQ ID NO: 276)
MKPHFRNTVERMYRDTFSYNFYNRPILSRRNTVWLCYEVKTKGPSRPRL

DAKIFRGQVYSQPEHHAEMCFLSWFCGNQLPAYKCFQITWFVSWTPCPD

CVAKLAEFLAEHPNVTLTISAARLYYYWERDYRRALCRLSQAGARVKIM

DDEEFAYCWENFVYSEGQPFMPWYKFDDNYAFLHRTLKEILRNPMEAMY

PHIFYFHFKNLRKAYGRNESWLCFTMEVVKHHSPVSWKRGVFRNQVDPE

THCHAERCFLSWFCDDILSPNTNYEVTWYTSWSPCPECAGEVAEFLARH

SNVNLTIFTARLYYFWDTDYQEGLRSLSQEGASVEIMGYKDFKYCWENF

VYNDDEPFKPWKGLKYNFLFLDSKLQEILE (italic: nucleic acid editing domain)
Human APOBEC-3B:

(SEQ ID NO: 277)
MNPQIRNPMERMYRDTFYDNFENEPILYGRSYTWLCYEVKIKRGRSNLL

WDTGVFRGQVYFKPQYHAEMCFLSWFCGNQLPAYKCFQITWFVSWTPCP

DCVAKLAEFLSEHPNVTLTISAARLYYYWERDYRRALCRLSQAGARVTI

MDYEEFAYCWENFVYNEGQQFMPWYKFDENYAFLHRTLKEIRYLMDPD

TFTFNFNNDPLVLRRRQTYLCYEVERLDNGTWVLMDQHMGFLCNEAKNL

LCGFYGRHAELRFLDLVPSLQLDPAQIYRVTWFISWSPCFSWGCAGEVR

AFLQENTHVRLRIFAARIYDYDPLYKEALQMLRDAGAQVSIMTYDEFEY

CWDTFVYRQGCPFQPWDGLEEHSQALSGRLRAILQNQGN (italic: nucleic acid editing domain)
Rat APOBEC-3B:

(SEQ ID NO: 5729)
MQPQGLGPNAGMGPVCLGCSHRRPYSPIRNPLKKLYQQTFYFHFKNVRY

AWGRKNNFLCYEVNGMDCALPVPLRQGVFRKQGHIHAELCFIYWFHDKV

WLRVLSPMEEFKVTYMSWSPCSKCAEQVARFLAAHRNLSLAIFSSRLYY

YLRNPNYQQKLCRLIQEGVHVAAMDLPEFKKCWNKFVDNDGQPFRPWMR

LRINFSFYDCKLQEIFSRMNLLREDVFYLQFNNSHRVKPVQNRYYRRKS

YLCYQLERANGQEPLKGYLLYKKGEQHVEILFLEKMRSMELSQVRITCY

LTWSPCPNCARQLAAFKKDHPDLILRIYTSRLYFYWRKKFQKGLCTLWR

SGIHVDVMDLPQFADCWTNFVNPQRPFRPWNELEKNSWRIQRRLRRIKE

SWGL

Bovine APOBEC-3B:

(SEQ ID NO: 5730)
DGWEVAFRSGTVLKAGVLGVSMTEGWAGSGHPGQGACVWTPGTRNTMN

LLREVLFKQQFGNQPRVPAPYYRRKTYLCYQLKQRNDLTLDRGCFRNK

-continued
KQRHAEIRFIDKINSLDLNPSQSYKIICYITWSPCPNCANELVNFITR
NNHLKLEIFASRLYFHWIKSFKMGLQDLQNAGISVAVMTHTEFEDCWE
QFVDNQSRPFQPWDKLEQYSASIRRRLQRILTAPI Chimpanzee APOBEC-3B:

(SEQ ID NO: 5731)
MNPQIRNPMEWMYQRTFYYNFENEPILYGRSYTWLCYEVKIRRGHSNLLW
DTGVFRGQMYSQPEHHAEMCFLSWFCGNQLSAYKCFQITWFVSWTPCPDC
VAKLAKFLAEHPNVTLTISAARLYYYWERDYRRALCRLSQAGARVKIMDD
EEFAYCWENFVYNEGQPFMPWYKFDDNYAFLHRTLKEIIRHLMDPDTFTF
NFNNDPLVLRRHQTYLCYEVERLDNGTWVLMDQHMGFLCNEAKNLLCGFY
GRHAELRFLDLVPSLQLDPAQIYRVTWFISWSPCFSWGCAGQVRAFLQEN
THVRLRIFAARIYDYDPLYKEALQMLRDAGAQVSIMTYDEFEYCWDTFVY
RQGCPFQPWDGLEEHSQALSGRLRAILQVRASSLCMVPHRPPPPPQSPGP
CLPLCSEPPLGSLLPTGRPAPSLPFLLTASFSFPPPASLPPLPSLSLSPG
HLPVPSFHSLTSCSIQPPCSSRIRETEGWASVSKEGRDLG

Human APOBEC-3C:

(SEQ ID NO: 278)
MNPQRNPMKAMYPGTFYFQFKNLWEANDRNETWLCFTVEGIKRRSVVSW
KTGVFRNQVDSETHC*HAERCFLSWFCDDILSPNTKYQVTWYTSWSPCPD*
*CAGEVAEFLARHSNVNLTIFTARLYYFQYPCYQEGLRSLSQEGVAVEIM*
*DYEDFKYCWENFVYNDNEPFKPWKGLKTNFRLLKRRLRESLQ*

(italic: nucleic acid editing domain)
Gorilla APOBEC3C (SEQ ID NO: 5726)
MNPQRNPMKAMYPGTFYFQFKNLWEANDRNETWLCFTVEGIKRRSVVSWK
TGVFRNQVDSETHC*HAERCFLSWFCDDILSPNTNYQVTWYTSWSPCPECA*
*GEVAEFLARHSNVNLTIFTARLYYFQDTDYQEGLRSLSQEGVAVKIMDYK*
*DFKYCWENFVYNDDEPFKPWKGLKYNFRFLKRRLQEILE*

(italic: nucleic acid editing domain)
Human APOBEC-3A:

(SEQ ID NO: 279)
MEASPASGPRHLMDPHIFTSNFNNGIGRHKTYLCYEVERLDNGTSVKMDQ
HRGFLHNQAKNLLCGFYGR*HAELRFLDLVPSLQLDPAQIYRVTWFISWSP*
*CFSWGC*AGEVRAFLQENTHVRLRIFAARIYDYDPLYKEALQMLRDAGAQV
SIMTYDEFKHCWDTFVDHQGCPFQPWDGLEHSQALSGRLRAILQNQGN (italic: nucleic acid editing domain)
Rhesus macaque APOBEC-3A:

(SEQ ID NO: 5727)
MDGSPASRPRHLMDPNTFTFNFNNDLSVRGRHQTYLCYEVERLDNGTWVP
MDERRGFLCNKAKNVPCGDYGC*HVELRFLCEVPSWQLDPAQTYRVTWFIS*
*WSPC*FRRGCAGQVRVFLQENKHVRLRIFAARIYDYDPLYQEALRTLRDAG
AQVSIMTYEEFKHCWDTFVDRQGRPFQPWDGLDEHSQALSGRLRAILQNQ
GN (italic: nucleic acid editing domain)
Bovine APOBEC-3A:

(SEQ ID NO: 5728)
MDEYTFTENFNNQGWPSKTYLCYEMERLDGDATIPLDEYKGFVRNKGLDQ
PEKPC*HAELYFLGKIHSWNLDRNQHYRLTCFISWSPCY*DCAQKLTTFLKE
NHHISLHILASRIYTHNRFGCHQSGLCELQAAGARITIMTFEDFKHCWET
FVDHKGKPFQPWEGLNVKSQALCTELQAILKTQQN (italic: nucleic acid editing domain)
Human APOBEC-3H:

(SEQ ID NO: 280)
MALLTAETFRLQFNNKRRLRRPYYPRKALLCYQLTPQNGSTPTRGYFENK
KKC*HAEICFINEIKSMGLDETQCYQVTCYLTWSPCSSC*AWELVDFIKAHD
HLNLGIFASRLYYHWCKPQQKGLRLLCGSQVPVEVMGFPKFADCWENFVD
HEKPLSFNPYKMLEELDKNSRAIKRRLERIKIPGVRAQGRYMDILCDAEV (italic: nucleic acid editing domain)
Rhesus macaque APOBEC-3H:

(SEQ ID NO: 5732)
MALLTAKTFSLQFNNKRRVNKPYYPRKALLCYQLTPQNGSTPTRGHLKNK
KKDHAEIRFINKIKSMGLDETQCYQVTCYLTWSPCPSCAGELVDFIKAHR
HLNLRIFASRLYYHWRPNYQEGLLLLCGSQVPVEVMGLPEFTDCWENFVD
HKEPPSFNPSEKLEELDKNSQAIKRRLERIKSRSVDVLENGLRSLQLGPV
TPSSSIRNSR

Human APOBEC-3D:

(SEQ ID NO: 281)
MNPQRNPMERMYRDTFYDNFENEPILYGRSYTWLCYEVKIKRGRSNLLW
DTGVFRGPVLPKRQSNHRQEVYFRFEN*HAEMCFLSWFCGNRLPANRRFQ*
*ITWFVSWNPCLPC*VVKVTKFLAEHPNVTLTISAARLYYYRDRDWRWVLL
RLHKAGARVKIMDYEDFAYCWENFVCNEGQPFMPWYKFDDNYASLHRTL
KEILRNPMEAMYPHIFYFHFKNLLKACGRNESWLCFTMEVTKHHSAVFR
KRGVFRNQVDPETHC*HAERCFLSWFCDDILSPNTNYEVTWYTSWSPCPE*
*CAGEVAEFLARHSNVNLTIFTARLCYFWDTDYQEGLCSLSQEGASVKIM*
GYKDFVSCWKNFVYSDDEPFKPWKGLQTNFRLLKRRLREILQ (italic: nucleic acid editing domain)
Human APOBEC-1:

(SEQ ID NO: 282)
MTSEKGPSTGDPTLRRRIEPWEFDVFYDPRELRKEACLLYEIKWGMSRKI
WRSSGKNTTNHVEVNFIKKFTSERDFHPSMSCSITWFLSWSPCWECSQAI
REFLSRHPGVTLVIYVARLFWHMDQQNRQGLRDLVNSGVTIQIMRASEYY

-continued

HCWRNFVNYPPGDEAHWPQYPPLWMMLYALELHCIILSLPPCLKISRRWQ

NHLTFFRLHLQNCHYQTIPPHILLATGLIHPSVAWR

Mouse APOBEC-1:

(SEQ ID NO: 283)
MSSETGPVAVDPTLRRRIEPHEFEVFFDPRELRKETCLLYEINWGGRHSV

WRHTSQNTSNHVEVNFLEKFTTERYFRPNTRCSITWFLSWSPCGECSRAI

TEFLSRHPYVTLFIYIARLYHHTDQRNRQGLRDLISSGVTIQIMTEQEYC

YCWRNFVNYPPSNEAYWPRYPHLWVKLYVLELYCIILGLPPCLKILRRKQ

PQLTFFTITLQTCHYQRIPPHLLWATGLK

Rat APOBEC-1:

(SEQ ID NO: 284)
MSSETGPVAVDPTLRRRIEPHEFEVFFDPRELRKETCLLYEINWGGRHS

IWRHTSQNTNKHVEVNFIEKFTTERYFCPNTRCSITWFLSWSPCGECSR

AITEFLSRYPHVTLFIYIARLYHHADPRNRQGLRDLISSGVTIQIMTEQ

ESGYCWRNFVNYSPSNEAHWPRYPHLWVRLYVLELYCIILGLPPCLNIL

RRKQPQLTFFTIALQSCHYQRLPPHILWATGLK

Human APOBEC-2:

(SEQ ID NO: 5733)
MAQKEEAAVATEAASQNGEDLENLDDPEKLKELIELPPFEIVTGERLPAN

FFKFQFRNVE

YSSGRNKTFLCYVVEAQGKGGQVQASRGYLEDEHAAAHAEEAFFNTILPA

FDPALRYNVTWYVSSSPCAACADRIIKTLSKTKNLRLLILVGRLFMWEEP

EIQAALKKLKEAGCKLRIMKPQDFEYVWQNFVEQEEGESKAFQPWEDIQE

NFLYYEEKLADILK

Mouse APOBEC-2:

(SEQ ID NO: 5734)
MAQKEEAAEAAAPASQNGDDLENLEDPEKLKELIDLPPFEIVTGVRLPVN

FFKFQFRNVEYSSGRNKTFLCYVVEVQSKGGQAQATQGYLEDEHAGAHAE

EAFFNTILPAFDPALKYNVTWYVSSSPCAACADRILKTLSKTKNLRLLIL

VSRLFMWEEPEVQAALKKLKEAGCKLRIMKPQDFEYIWQNFVEQEEGESK

AFEPWEDIQENFLYYEEKLADILK

Rat APOBEC-2:

(SEQ ID NO: 5735)
MAQKEEAAEAAAPASQNGDDLENLEDPEKLKELIDLPPFEIVTGVRLPV

NFFKFQFRNVEYSSGRNKTFLCYVVEAQSKGGQVQATQGYLEDEHAGAH

AEEAFFNTILPAFDPALKYNVTWYVSSSPCAACADRILKTLSKTKNLRL

LILVSRLFMWEEPEVQAALKKLKEAGCKLRIMKPQDFEYLWQNFVEQEE

GESKAFEPWEDIQENFLYYEEKLADILK

Bovine APOBEC-2:

(SEQ ID NO: 5736)
MAQKEEAAAAAEPASQNGEEVENLEDPEKLKELIELPPFEIVTGERLPAH

YFKFQFRNVE

YSSGRNKTFLCYVVEAQSKGGQVQASRGYLEDEHATNHAEEAFFNSIMPT

FDPALRYMVTWYVSSSPCAACADRIVKTLNKTKNLRLLILVGRLFMWEEP

EIQAALRKLKEAGCRLRIMKPQDFEYIWQNFVEQEEGESKAFEPWEDIQE

NFLYYEEKLADILK

*Petromyzon marinus* CDA1 (pmCDA1)

(SEQ ID NO: 5738)
MTDAEYVRIHEKLDIYTFKKQFFNNKKSVSHRCYVLFELKRRGERRACF

WGYAVNKPQSGTERGIHAEIFSIRKVEEYLRDNPGQFTINWYSSWSPCA

DCAEKILEWYNQELRGNGHTLKIWACKLYYEKNARNQIGLWNLRDNGVG

LNVMVSEHYQCCRKIFIQSSHNQLNENRWLEKTLKRAEKRRSELSIMIQ

VKILHTTKSPAV

Human APOBEC3G D316R_D317R (SEQ ID NO: 5739)
MKPHFRNTVERMYRDTFSYNFYNRPILSRRNTVWLCYEVKTKGPSRPPL

DAKIFRGQVYSELKYHPEMRFFHWFSKWRKLHRDQEYEVTWYISWSPCT

KCTRDMATFLAEDPKVTLTIFVARLYYFWDPDYQEALRSLCQKRDGPRA

TMKIMNYDEFQHCWSKFVYSQRELFEPWNNLPKYYILLHIMLGEILRHS

MDPPTFTFNFNNEPWVRGRHETYLCYEVERMHNDTWVLLNQRRGFLCNQ

APHKHGFLEGRHAELCFLDVIPFWKLDLDQDYRVTCFTSWSPCFSCAQE

MAKFISKNKHVSLCIFTARIYRRQGRCQEGLRTLAEAGAKISIMTYSEF

KHCWDTFVDHQGCPFQPWDGLDEHSQDLSGRLRAILQNQEN

Human APOBEC3G chain A (SEQ ID NO: 5740)
MDPPTFTFNFNNEPWVRGRHETYLCYEVERMHNDTWVLLNQRRGFLCNQA

PHKHGFLEGRHAELCFLDVIPFWKLDLDQDYRVTCFTSWSPCFSCAQEMA

KFISKNKHVSLCIFTARIYDDQGRCQEGLRTLAEAGAKISIMTYSEFKHC

WDTFVDHQGCPFQPWDGLDEHSQDLSGRLRAILQ

Human APOBEC3G chain A D120R_D121R (SEQ ID NO: 5741)
MDPPTFTFNFNNEPWVRGRHETYLCYEVERMHNDTWVLLNQRRGFLCNQ

APHKHGFLEGRHAELCFLDVIPFWKLDLDQDYRVTCFTSWSPCFSCAQE

MAKFISKNKHVSLFTARIYRRQGRCQEGLRTLAEAGAKISIMTYSEFKH

CWDTFVDHQGCPFQPWDGLDEHSQDLSGRLRAILQ

In some embodiments, fusion proteins as provided herein comprise the full-length amino acid of a nucleic acid editing enzyme, e.g., one of the sequences provided above. In other embodiments, however, fusion proteins as provided herein do not comprise a full-length sequence of a nucleic acid editing enzyme, but only a fragment thereof. For example, in some embodiments, a fusion protein provided herein comprises a Cas9 domain and a fragment of a nucleic acid editing enzyme, e.g., wherein the fragment comprises a nucleic acid editing domain. Exemplary amino acid sequences of nucleic acid editing domains are shown in the sequences above as italicized letters, and additional suitable sequences of such domains will be apparent to those of skill in the art.

Additional suitable nucleic-acid editing enzyme sequences, e.g., deaminase enzyme and domain sequences, that can be used according to aspects of this invention, e.g., that can be fused to a nuclease-inactive Cas9 domain, will be apparent to those of skill in the art based on this disclosure. In some embodiments, such additional enzyme sequences include deaminase enzyme or deaminase domain sequences that are at least 70%, at least 75%, at least 80%, at least 85%, at least 90%, at least 95%, at least 96%, at least 97%, at least 98%, or at least 99% similar to the sequences provided herein. Additional suitable Cas9 domains, variants, and sequences will also be apparent to those of skill in the art. Examples of such additional suitable Cas9 domains include, but are not limited to, D10A, D10A/D839A/H840A, and D10A/D839A/H840A/N863A mutant domains (See, e.g., Prashant et al., CAS9 transcriptional activators for target specificity screening and paired nickases for cooperative genome engineering. Nature Biotechnology. 2013; 31(9): 833-838 the entire contents of which are incorporated herein by reference). In some embodiments, the Cas9 comprises a histidine residue at position 840 of the amino acid sequence provided in SEQ ID NO: 10, or a corresponding mutation in any of the amino acid sequences provided in SEQ ID NOs: 11-260. The presence of the catalytic residue H840 restores the acvitity of the Cas9 to cleave the non-edited strand containing a G opposite the targeted C. Restoration of H840 does not result in the cleavage of the target strand containing the C.

Additional suitable strategies for generating fusion proteins comprising a Cas9 domain and a deaminase domain will be apparent to those of skill in the art based on this disclosure in combination with the general knowledge in the art. Suitable strategies for generating fusion proteins according to aspects of this disclosure using linkers or without the use of linkers will also be apparent to those of skill in the art in view of the instant disclosure and the knowledge in the art. For example, Gilbert et al., CRISPR-mediated modular RNA-guided regulation of transcription in eukaryotes. *Cell.* 2013; 154(2):442-51, showed that C-terminal fusions of Cas9 with VP64 using 2 NLS's as a linker (SPKKKRK-VEAS, SEQ ID NO: 599), can be employed for transcriptional activation. Mali et al., CAS9 transcriptional activators for target specificity screening and paired nickases for cooperative genome engineering. *Nat Biotechnol.* 2013; 31(9):833-8, reported that C-terminal fusions with VP64 without linker can be employed for transcriptional activation. And Maeder et al., CRISPR RNA-guided activation of endogenous human genes. *Nat Methods.* 2013; 10: 977-979, reported that C-terminal fusions with VP64 using a Gly$_4$Ser (SEQ ID NO: 5) linker can be used as transcriptional activators. Recently, dCas9-FokI nuclease fusions have successfully been generated and exhibit improved enzymatic specificity as compared to the parental Cas9 enzyme (In Guilinger J P, Thompson D B, Liu D R. Fusion of catalytically inactive Cas9 to FokI nuclease improves the specificity of genome modification. *Nat. Biotechnol.* 2014; 32(6): 577-82, and in Tsai S Q, Wyvekens N, Khayter C, Foden J A, Thapar V, Reyon D, Goodwin M J, Aryee M J, Joung J K. Dimeric CRISPR RNA-guided FokI nucleases for highly specific genome editing. *Nat Biotechnol.* 2014; 32(6):569-76. PMID: 24770325 a SGSETPGTSESATPES (SEQ ID NO: 7) or a GGGGS (SEQ ID NO: 5) linker was used in FokI-dCas9 fusion proteins, respectively).

Some aspects of this disclosure provide fusion proteins comprising (i) a Cas9 enzyme or domain (e.g., a first protein); and (ii) a nucleic acid-editing enzyme or domain (e.g., a second protein). In some aspects, the fusion proteins provided herein further include (iii) a programmable DNA-binding protein, for example, a zinc-finger domain, a TALE, or a second Cas9 protein (e.g., a third protein). Without wishing to be bound by any particular theory, fusing a programmable DNA-binding protein (e.g., a second Cas9 protein) to a fusion protein comprising (i) a Cas9 enzyme or domain (e.g., a first protein); and (ii) a nucleic acid-editing enzyme or domain (e.g., a second protein) may be useful for improving specificity of the fusion protein to a target nucleic acid sequence, or for improving specificity or binding affinity of the fusion protein to bind target nucleic acid sequence that does not contain a canonical PAM (NGG) sequence. In some embodiments, the third protein is a Cas9 protein (e.g, a second Cas9 protein). In some embodiments, the third protein is any of the Cas9 proteins provided herein. In some embodiments, the third protein is fused to the fusion protein N-terminal to the Cas9 protein (e.g., the first protein). In some embodiments, the third protein is fused to the fusion protein C-terminal to the Cas9 protein (e.g., the first protein). In some embodiments, the Cas9 domain (e.g., the first protein) and the third protein (e.g., a second Cas9 protein) are fused via a linker (e.g., a second linker). In some embodiments, the linker comprises a (GGGGS)n (SEQ ID NO: 5), a (G)n, an (EAAAK)n (SEQ ID NO: 6), a (GGS)n, (SGGS)$_n$ (SEQ ID NO: 4288), an SGSETPGTSESATPES (SEQ ID NO: 7), or an (XP)n motif, or a combination of any of these, wherein n is independently an integer between 1 and 30. In some embodiments, the general architecture of exemplary Cas9 fusion proteins provided herein comprises the structure:

[NH2]-[nucleic acid-editing enzyme or domain]-[Cas9]-[third protein]-[COOH];

[NH2]-[third protein]-[Cas9]-[nucleic acid-editing enzyme or domain]-[COOH];

[NH2]-[Cas9]-[nucleic acid-editing enzyme or domain]-[third protein]-[COOH];

[NH2]-[third protein]-[nucleic acid-editing enzyme or domain]-[Cas9]-[COOH];

[NH2]-[UGI]-[nucleic acid-editing enzyme or domain]-[Cas9]-[third protein]-[COOH];

[NH2]-[UGI]-[third protein]-[Cas9]-[nucleic acid-editing enzyme or domain]-[COOH];

[NH2]-[UGI]-[Cas9]-[nucleic acid-editing enzyme or domain]-[third protein]-[COOH];

[NH2]-[UGI]-[third protein]-[nucleic acid-editing enzyme or domain]-[Cas9]-[COOH];

[NH2]-[nucleic acid-editing enzyme or domain]-[Cas9]-[third protein]-[UGI]-[COOH];

[NH2]-[third protein]-[Cas9]-[nucleic acid-editing enzyme or domain]-[UGI]-[COOH];

[NH2]-[Cas9]-[nucleic acid-editing enzyme or domain]-[third protein]-[UGI]-[COOH]; or

[NH2]-[third protein]-[nucleic acid-editing enzyme or domain]-[Cas9]-[UGI]-[COOH];

wherein NH2 is the N-terminus of the fusion protein, and COOH is the C-terminus of the fusion protein. In some embodiments, the "]-[" used in the general architecture above indicates the presence of an optional linker sequence. In other examples, the general architecture of exemplary Cas9 fusion proteins provided herein comprises the structure:

[NH2]-[nucleic acid-editing enzyme or domain]-[Cas9]-[second Cas9 protein]-[COOH];
[NH2]-[second Cas9 protein]-[Cas9]-[nucleic acid-editing enzyme or domain]-[COOH];
[NH2]-[Cas9]-[nucleic acid-editing enzyme or domain]-[second Cas9 protein]-[COOH];
[NH2]-[second Cas9 protein]-[nucleic acid-editing enzyme or domain]-[Cas9]-[COOH];
[NH2]-[UGI]-[nucleic acid-editing enzyme or domain]-[Cas9]-[second Cas9 protein]-[COOH],
[NH2]-[UGI]-[second Cas9 protein]-[Cas9]-[nucleic acid-editing enzyme or domain]-[COOH];
[NH2]-[UGI]-[Cas9]-[nucleic acid-editing enzyme or domain]-[second Cas9 protein]-[COOH];
[NH2]-[UGI]-[second Cas9 protein]-[nucleic acid-editing enzyme or domain]-[Cas9]-[COOH];
[NH2]-[nucleic acid-editing enzyme or domain]-[Cas9]-[second Cas9 protein]-[UGI]-[COOH];
[NH2]-[second Cas9 protein]-[Cas9]-[nucleic acid-editing enzyme or domain]-[UGI]-[COOH];
[NH2]-[Cas9]-[nucleic acid-editing enzyme or domain]-[second Cas9 protein]-[UGI]-[COOH]; or
[NH2]-[second Cas9 protein]-[nucleic acid-editing enzyme or domain]-[Cas9]-[UGI]-[COOH];

wherein NH$_2$ is the N-terminus of the fusion protein, and COOH is the C-terminus of the fusion protein. In some embodiments, the "]-[" used in the general architecture above indicates the presence of an optional linker sequence. In some embodiments, the second Cas9 is a dCas9 protein. In some examples, the general architecture of exemplary Cas9 fusion proteins provided herein comprises a structure as shown in FIG. 3. It should be appreciated that any of the proteins provided in any of the general architectures of exemplary Cas9 fusion proteins may be connected by one or more of the linkers provided herein. In some embodiments, the linkers are the same. In some embodiments, the linkers are different. In some embodiments, one or more of the proteins provided in any of the general architectures of exemplary Cas9 fusion proteins are not fused via a linker. In some embodiments, the fusion proteins further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the third protein. In some embodiments, the NLS is fused to the C-terminus of the third protein. In some embodiments, the NLS is fused to the N-terminus of the Cas9 protein. In some embodiments, the NLS is fused to the C-terminus of the Cas9 protein. In some embodiments, the NLS is fused to the N-terminus of the nucleic acid-editing enzyme or domain. In some embodiments, the NLS is fused to the C-terminus of the nucleic acid-editing enzyme or domain. In some embodiments, the NLS is fused to the N-terminus of the UGI protein. In some embodiments, the NLS is fused to the C-terminus of the UGI protein. In some embodiments, the NLS is fused to the fusion protein via one or more linkers. In some embodiments, the NLS is fused to the fusion protein without a linker Uracil Glycosylase Inhibitor Fusion Proteins Some aspects of the disclosure relate to fusion proteins that comprise a uracil glycosylase inhibitor (UGI) domain. In some embodiments, any of the fusion proteins provided herein that comprise a Cas9 domain (e.g., a nuclease active Cas9 domain, a nuclease inactive dCas9 domain, or a Cas9 nickase) may be further fused to a UGI domain either directly or via a linker. Some aspects of this disclosure provide deaminase-dCas9 fusion proteins, deaminase-nuclease active Cas9 fusion proteins and deaminase-Cas9 nickase fusion proteins with increased nucleobase editing efficiency. Without wishing to be bound by any particular theory, cellular DNA-repair response to the presence of U:G heteroduplex DNA may be responsible for the decrease in nucleobase editing efficiency in cells. For example, uracil DNA glycosylase (UDG) catalyzes removal of U from DNA in cells, which may initiate base excision repair, with reversion of the U:G pair to a C:G pair as the most common outcome. As demonstrated in the Examples below, Uracil DNA Glycosylase Inhibitor (UGI) may inhibit human UDG activity. Thus, this disclosure contemplates a fusion protein comprising dCas9-nucleic acid editing domain further fused to a UGI domain. This disclosure also contemplates a fusion protein comprising a Cas9 nickase-nucleic acid editing domain further fused to a UGI domain. It should be understood that the use of a UGI domain may increase the editing efficiency of a nucleic acid editing domain that is capable of catalyzing a C to U change. For example, fusion proteins comprising a UGI domain may be more efficient in deaminating C residues. In some embodiments, the fusion protein comprises the structure:

[deaminase]-[optional linker sequence]-[dCas9]-[optional linker sequence]-[UGI];
[deaminase]-[optional linker sequence]-[UGI]-[optional linker sequence]-[dCas9];
[UGI]-[optional linker sequence]-[deaminase]-[optional linker sequence]-[dCas9];
[UGI]-[optional linker sequence]-[dCas9]-[optional linker sequence]-[deaminase];
[dCas9]-[optional linker sequence]-[deaminase]-[optional linker sequence]-[UGI]; or
[dCas9]-[optional linker sequence]-[UGI]-[optional linker sequence]-[deaminase].

In other embodiments, the fusion protein comprises the structure:

[deaminase]-[optional linker sequence]-[Cas9 nickase]-[optional linker sequence]-[UGI];
[deaminase]-[optional linker sequence]-[UGI]-[optional linker sequence]-[Cas9 nickase];
[UGI]-[optional linker sequence]-[deaminase]-[optional linker sequence]-[Cas9 nickase];
[UGI]-[optional linker sequence]-[Cas9 nickase]-[optional linker sequence]-[deaminase];
[Cas9 nickase]-[optional linker sequence]-[deaminase]-[optional linker sequence]-[UGI]; or
[Cas9 nickase]-[optional linker sequence]-[UGI]-[optional linker sequence]-[deaminase].

In some embodiments, the fusion proteins provided herein do not comprise a linker sequence. In some embodiments, one or both of the optional linker sequences are present.

In some embodiments, the "-" used in the general architecture above indicates the presence of an optional linker sequence. In some embodiments, the fusion proteins comprising a UGI further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the Cas9 protein. In some embodiments, the NLS is fused to the C-terminus of the Cas9 protein. In some embodiments, the NLS is fused to the N-terminus of the deaminase. In some embodiments, the NLS is fused to the C-terminus of the deaminase. In some embodiments, the NLS is fused to the N-terminus of the second Cas9. In some embodiments, the NLS is fused to the C-terminus of the second Cas9. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 741or SEQ ID NO: 742.

In some embodiments, a UGI domain comprises a wild-type UGI or a UGI as set forth in SEQ ID NO: 600. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 600. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 600. In some embodiments, a UGI comprises an amino acid sequence homologous to the amino acid sequence set forth in SEQ ID NO: 600 or an amino acid sequence homologous to a fragment of the amino acid sequence set forth in SEQ ID NO: 600. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 600. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 600. In some embodiments, the UGI comprises the following amino acid sequence:

```
>sp|P14739|UNGI_BPPB2 Uracil-DNA glycosylase
inhibitor
                                      (SEQ ID NO: 600)
MTNLSDIIEKETGKQLVIQESILMLPEEVEEVIGNKPESDILVHTAYDES

TDENVMLLTSDAPEYKPWALVIQDSNGENKIKML
```

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. J. Biol. Chem. 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. J. Biol. Chem. 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. Nucleic Acids Res. 26:4880-4887(1998); and Putnam et al., Protein mimicry of DNA from crystal structures of the uracil-DNA glycosylase inhibitor protein and its complex with *Escherichia coli* uracil-DNA glycosylase. J. Mol. Biol. 287:331-346(1999), the entire contents of each are incorporated herein by reference.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. Additionally, any proteins that block or inhibit base-excision repair as also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a Erwinia tasmaniensis single-stranded binding protein. In some embodiments, the single-stranded binding protein comprises the amino acid sequence (SEQ ID NO: 322). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 323). As another example, a uracil glycosylase inhibitor is a catalytically inactive UDG. In some embodiments, a catalytically inactive UDG comprises the amino acid sequence (SEQ ID NO: 324). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 322-324. In some embodiments, a uracil glycosylase inhibitor is a protein that is at least 50% identical, at least 55% identical at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 322-324.

Erwinia tasmaniensis SSB (themostable single-stranded DNA binding protein)

```
                                      (SEQ ID NO: 322)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP
```

UdgX (binds to Uracil in DNA but does not excise)

(SEQ ID NO: 323)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (catalytically inactive human UDG, binds to Uracil in DNA but does not excise)

(SEQ ID NO: 324)
MIGQKTLYSFFSPSPARKRHAPSPEPAVQGTGVAGVPEESGDAAAIPAK

KAPAGQEEPGTPPSSPLSAEQLDRIQRNKAAALLRLAARNVPVGFGESW

KKHLSGEFGKPYFIKLMGFVAEERKHYTVYPPPHQVFTWTQMCDIKDVK

VVILGQEPYHGPNQAHGLCFSVQRPVPPPPSLENIYKELSTDIEDFVHP

GHGDLSGWAKQGVLLLNAVLTVRAHQANSHKERGWEQFTDAVVSWLNQN

SNGLVFLLWGSYAQKKGSAIDRKRHHVLQTAHPSPLSVYRGFFGCRHFS

KTNELLQKSGKKPIDWKEL

In some embodiments, the nucleic acid editing domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the demianse is a rat APOBEC1 (SEQ ID NO: 282). In some embodiments, the deminase is a human APOBEC1 (SEQ ID No: 284). In some embodiments, the deaminase is a *Petromyzon marinus* cytidine deaminase 1 (pmCDA1). In some embodiments, the deminase is a human APOBEC3G (SEQ ID NO: 275). In some embodiments, the deaminase is a fragment of the human APOBEC3G (SEQ ID NO: 5740). In some embodiments, the deaminase is a human APOBEC3G variant comprising a D316R_D317R mutation (SEQ ID NO: 5739). In some embodiments, the deaminase is a frantment of the human APOBEC3G and comprising mutations corresponding to the D316R_D317R mutations in SEQ ID NO: 275 (SEQ ID NO: 5741).

In some embodiments, the linker comprises a (GGGS)$_n$ (SEQ ID NO: 265), (GGGGS)$_n$ (SEQ ID NO: 5), a (G)$_n$, an (EAAAK)$_n$ (SEQ ID NO: 6), a (GGS)$_n$, an SGSETPGT-SESATPES (SEQ ID NO: 7), or an (XP)$_n$ motif, or a combination of any of these, wherein n is independently an integer between 1 and 30.

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of which are incorporated herein by reference. In some embodiments, the optional linker comprises a (GGS)$_n$ motif, wherein n is 1, 2, 3, 4, 5, 6, 7, 8, 9, 19, 11, 12, 13, 14, 15, 16, 17, 18, 19, or 20. In some embodiments, the optional linker comprises a (GGS)n motif, wherein n is 1, 3, or 7. In some embodiments, the optional linker comprises the amino acid sequence SGSETPGTSESATPES (SEQ ID NO: 7), which is also referred to as the XTEN linker in the Examples.

In some embodiments, a Cas9 nickase may further facilitate the removal of a base on the non-edited strand in an organism whose genome is edited in vivo. The Cas9 nickase, as described herein, may comprise a D10A mutation in SEQ ID NO: 10, or a corresponding mutation in any of SEQ ID NOs: 11-260. In some embodiments, the Cas9 nickase of this disclosure may comprise a histidine at mutation 840 of SEQ ID NO: 10, or a corresponding residue in any of SEQ ID NOs: 11-260. Such fusion proteins comprising the Cas9 nickase, can cleave a single strand of the target DNA sequence, e.g., the strand that is not being edited. Without wishing to be bound by any particular theory, this cleavage may inhibit mis-match repair mechanisms that reverse a C to U edit made by the deaminase.

Cas9 Complexes with Guide RNAs

Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide RNA is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide RNA is complementary to a sequence associated with a disease or disorder. In some embodiments, the guide RNA is complementary to a sequence associated with a disease or disorder having a mutation in a gene selected from the genes disclosed in any one of Tables 1-3. In some embodiments, the guide RNA comprises a nucleotide sequence of any one of the guide sequences provided in Table 2 or Table 3. Exemplary sequences in the human genome that may be targeted by the complexes of this disclosure are provided herein in Tables 1-3.

Methods of Using Cas9 Fusion Proteins

Some aspects of this disclosure provide methods of using the Cas9 proteins, fusion proteins, or complexes provided herein. For example, some aspects of this disclosure provide methods comprising contacting a DNA molecule (a) with any of the the Cas9 proteins or fusion proteins provided herein, and with at least one guide RNA, wherein the guide RNA is about 15-100 nucleotides long and comprises a sequence of at least 10 contiguous nucleotides that is complementary to a target sequence; or (b) with a Cas9 protein, a Cas9 fusion protein, or a Cas9 protein or fusion protein complex with at least one gRNA as provided herein. In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the Cas9 protein, the Cas9 fusion protein, or the complex results in a correction of the point mutation. In some embodiments, the target DNA sequence comprises a T→C point mutation associated with a disease or disorder, and wherein the deamination of the mutant C base results in a sequence that is not associated with a disease or disorder. In some embodiments, the target DNA sequence encodes a protein and wherein the point mutation is in a codon and results in a change in the amino acid encoded by the mutant codon as compared to the wild-type codon. In some embodiments, the deamination of the mutant C results in a change of the amino acid encoded by the mutant codon. In some embodiments, the deamination of the mutant C results in the codon encoding the wild-type amino acid. In some embodiments, the contacting is in vivo in a subject. In some embodiments, the subject has or has been diagnosed with a disease or disorder. In some embodiments, the disease or disorder is cystic fibrosis, phenylketonuria, epidermolytic hyperkeratosis (EHK), Charcot-Marie-Toot disease type 4J, neuroblastoma (NB), von Willebrand disease (vWD), myotonia congenital, hereditary renal amyloidosis, dilated cardiomyopathy (DCM), hereditary lymphedema, familial Alzheimer's disease, HIV, Prion disease, chronic infantile neurologic cutaneous particular syndrome (CINCA), desmin-related myopathy (DRM), a neoplastic disease associated with a mutant PI3KCA protein, a mutant CTNNB1 protein, a mutant HRAS protein, or a mutant p53 protein.

Some embodiments provide methods for using the Cas9 DNA editing fusion proteins provided herein. In some embodiments, the fusion protein is used to introduce a point mutation into a nucleic acid by deaminating a target nucleobase, e.g., a C residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a Cas9 DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provide herein is to restore the function of a dysfunctional gene via genome editing. The Cas9 deaminase fusion proteins provided herein can be validated for gene editing-based human therapeutics in vitro, e.g., by correcting a disease-associated mutation in human cell culture. It will be understood by the skilled artisan that the fusion proteins provided herein, e.g., the fusion proteins comprising a Cas9 domain and a nucleic acid deaminase domain can be used to correct any single point T→C or A→G mutation. In the first case, deamination of the mutant C back to U corrects the mutation, and in the latter case, deamination of the C that is base-paired with the mutant G, followed by a round of replication, corrects the mutation.

An exemplary disease-relevant mutation that can be corrected by the provided fusion proteins in vitro or in vivo is the H1047R (A3140G) polymorphism in the PI3KCA protein. The phosphoinositide-3-kinase, catalytic alpha subunit (PI3KCA) protein acts to phosphorylate the 3-OH group of the inositol ring of phosphatidylinositol. The PI3KCA gene has been found to be mutated in many different carcinomas, and thus it is considered to be a potent oncogene.[37] In fact, the A3140G mutation is present in several NCI-60 cancer cell lines, such as, for example, the HCT116, SKOV3, and T47D cell lines, which are readily available from the American Type Culture Collection (ATCC).[38]

In some embodiments, a cell carrying a mutation to be corrected, e.g., a cell carrying a point mutation, e.g., an A3140G point mutation in exon 20 of the PI3KCA gene, resulting in a H1047R substitution in the PI3KCA protein, is contacted with an expression construct encoding a Cas9 deaminase fusion protein and an appropriately designed sgRNA targeting the fusion protein to the respective mutation site in the encoding PI3KCA gene. Control experiments can be performed where the sgRNAs are designed to target the fusion enzymes to non-C residues that are within the PI3KCA gene. Genomic DNA of the treated cells can be extracted, and the relevant sequence of the PI3KCA genes PCR amplified and sequenced to assess the activities of the fusion proteins in human cell culture.

It will be understood that the example of correcting point mutations in PI3KCA is provided for illustration purposes and is not meant to limit the instant disclosure. The skilled artisan will understand that the instantly disclosed DNA-editing fusion proteins can be used to correct other point mutations and mutations associated with other cancers and with diseases other than cancer including other proliferative diseases.

The successful correction of point mutations in disease-associated genes and alleles opens up new strategies for gene correction with applications in therapeutics and basic research. Site-specific single-base modification systems like the disclosed fusions of Cas9 and deaminase enzymes or domains also have applications in "reverse" gene therapy, where certain gene functions are purposely suppressed or abolished. In these cases, site-specifically mutating Trp (TGG), Gln (CAA and CAG), or Arg (CGA) residues to premature stop codons (TAA, TAG, TGA) can be used to abolish protein function in vitro, ex vivo, or in vivo.

The instant disclosure provides methods for the treatment of a subject diagnosed with a disease associated with or caused by a point mutation that can be corrected by a Cas9 DNA editing fusion protein provided herein. For example, in some embodiments, a method is provided that comprises administering to a subject having such a disease, e.g., a cancer associated with a PI3KCA point mutation as described above, an effective amount of a Cas9 deaminase fusion protein that corrects the point mutation or introduces a deactivating mutation into the disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation, cystic fibrosis (see, e.g., Schwank et al., Functional repair of CFTR by CRISPR/Cas9 in intestinal stem cell organoids of cystic fibrosis patients. *Cell stem cell.* 2013; 13: 653-658; and Wu et. al., Correction of a genetic disease in mouse via use of CRISPR-Cas9. *Cell stem cell.* 2013; 13: 659-662, neither of which uses a deaminase fusion protein to correct the genetic defect); phenylketonuria—e.g., phenylalanine to serine mutation at position 835 (mouse) or 240 (human) or a homologous residue in phenylalanine hydroxylase gene (T>C mutation)—see, e.g., McDonald et al., *Genomics.* 1997; 39:402-405; Bernard-Soulier syndrome (BSS)—e.g., phenylalanine to serine mutation at position 55 or a homologous residue, or cysteine to arginine at residue 24 or a homologous residue in the platelet membrane glycoprotein IX (T>C mutation)—see, e.g., Noris et al., *British Journal of Haematology.* 1997; 97: 312-320, and Ali et al., *Hematol.* 2014; 93: 381-384; epidermolytic hyperkeratosis (EHK)—e.g., leucine to proline mutation at position 160 or 161 (if counting the initiator methionine) or a homologous residue in keratin 1 (T>C mutation)—see, e.g., Chipev et al., *Cell.* 1992; 70: 821-828, see also accession number P04264 in the UNIPROT database at www[dot]uniprot[dot]org; chronic obstructive pulmonary disease (COPD)—e.g., leucine to proline mutation at position 54 or 55 (if counting the initiator methionine) or a homologous residue in the processed form of $α_1$-antitrypsin or residue 78 in the unprocessed form or a homologous residue (T>C mutation)—see, e.g., Poller et al., *Genomics.* 1993; 17: 740-743, see also accession number P01011 in the UNIPROT database; Charcot-Marie-Toot disease type 4J—e.g., isoleucine to threonine mutation at position 41 or a homologous residue in FIG4 (T>C mutation)—see, e.g., Lenk et al., *PLoS Genetics.* 2011; 7: e1002104; neuroblastoma (NB)—e.g., leucine to proline mutation at position 197 or a homologous residue in Caspase-9 (T>C mutation)—see, e.g., Kundu et al., 3 *Biotech.* 2013, 3:225-234; von Willebrand disease (vWD)—e.g., cysteine to arginine mutation at position 509 or a homologous residue in the processed form of von Willebrand factor, or at position 1272 or a homologous residue in the unprocessed form of von Willebrand factor (T>C mutation)—see, e.g., Lavergne et al., *Br. J. Haematol.* 1992, see also accession number P04275 in the UNIPROT database; 82: 66-72; myotonia congenital—e.g., cysteine to arginine mutation at position 277 or a homologous residue in the muscle chloride channel gene CLCN1 (T>C mutation)—see, e.g., Weinberger et al., *The J. of Physiology.* 2012; 590: 3449-3464; hereditary renal amyloidosis—e.g., stop codon to arginine mutation at position 78 or a homologous residue in the processed form of apolipoprotein AII or at position 101 or a homologous residue in the unprocessed form (T>C mutation)—see, e.g., Yazaki et al., *Kidney Int.* 2003; 64: 11-16; dilated cardiomyopathy (DCM)—e.g., tryptophan to Arginine mutation at position 148 or a homologous residue in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 or a homologous residue in VEGFR3 tyrosine kinase (A>G mutation), see, e.g., Irrthum et al., *Am. J. Hum. Genet.* 2000; 67: 295-301; familial Alzheimer's disease—e.g., isoleucine to valine mutation at position 143 or a homologous residue in presenilin1 (A>G mutation), see, e.g., Gallo et. al., *J. Alzheimer's disease.* 2011; 25: 425-431; Prion disease—e.g., methionine to valine mutation at position 129 or a homologous residue in prion protein (A>G mutation)—see, e.g., Lewis et. al., *J. of General Virology.* 2006; 87: 2443-2449; chronic infantile neurologic cutaneous particular syndrome (CINCA)—e.g., Tyrosine to Cysteine mutation at position 570 or a homologous residue in cryopyrin (A>G mutation)—see, e.g., Fujisawa et. al. *Blood.* 2007; 109: 2903-2911; and desmin-related myopathy (DRM)—e.g., arginine to glycine mutation at position 120 or a homologous residue in αβ crystallin (A>G mutation)—see, e.g., Kumar et al., *J. Biol. Chem.* 1999; 274: 24137-24141. The entire contents of all references and database entries is incorporated herein by reference.

The instant disclosure provides lists of genes comprising pathogenic T>C or A>G mutations. Provided herein, are the names of these genes, their respective SEQ ID NOs, their gene IDs, and sequences flanking the mutation site. (Tables 2 and 3). In some instances, the gRNA sequences that can be used to correct the mutations in these genes are disclosed (Tables 2 and 3).

In some embodiments, a Cas9-deaminase fusion protein recognizes canonical PAMs and therefore can correct the pathogenic T>C or A>G mutations with canonical PAMs, e.g., NGG (listed in Tables 2 and 3, SEQ ID NOs: 2540-2702 and 5084-5260), respectively, in the flanking sequences. For example, the Cas9 proteins that recognize canonical PAMs comprise an amino acid sequence that is at least 90% identical to the amino acid sequence of *Streptococcus pyogenes* Cas9 as provided by SEQ ID NO: 10, or to a fragment thereof comprising the RuvC and HNH domains of SEQ ID NO: 10.

It will be apparent to those of skill in the art that in order to target a Cas9:nucleic acid editing enzyme/domain fusion protein as disclosed herein to a target site, e.g., a site comprising a point mutation to be edited, it is typically necessary to co-express the Cas9:nucleic acid editing enzyme/domain fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcuagaaauagcaaguuaaaauaaaggcuaguccguuaucaacuugaaaaaguggcaccgagucggugcuu uuu-3' (SEQ ID NO: 601), wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting Cas9:nucleic acid editing enzyme/domain fusion proteins to specific target sequences are provided below.

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a cytosine (C) to thymine (T) point mutation associated with a disease or disorder. In some embodiments, the intended mutation is a guanine (G) to adenine (A) point mutation associated with a disease or disorder. In some embodiments, the intended mutation is a cytosine (C) to thymine (T) point mutation within the coding region of a gene. In some embodiments, the intended mutation is a guanine (G) to adenine (A) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characterstics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to a cytidine deaminase domain) and a guide nucleic acid (e.g., gRNA), wherein the target region comprises a targeted nucleobase pair, b) inducing strand separation of said target region, c)converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase; and the method results in less than 20% indel formation in the nucleic acid. It should be appreciated that in some embodiments, step b is omitted. In some embodiments, the first nucleobase is a cytosine. In some embodiments, the second nucleobase is a deaminated cytosine, or a uracil. In some embodiments, the third nucleobase is a guanine. In some embodiments, the fourth nucleobase is an adenine. In some embodiments, the first nucleobase is a cytosine, the second nucleobase is a deaminated cytosine, or a uracil, the third nucleobase is a guanine, and the fourth nucleobase is an adenine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., C:G->T:A). In some embodiments, the fifth nucleobase is a thymine. In some embodiments, at least 5% of the intended basepairs are edited. In some embodiments, at least 10%, 15%, 20%, 25%, 30%, 35%, 40%, 45%, or 50% of the intended basepaires are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is cytosine, and the second base is not a G, C, A, or T. In some embodiments, the second base is uracil. In some embodiments, the first base is cytosine. In some embodiments, the second base is not a G, C, A, or T. In some embodiments, the second base is uracil. In some embodiments, the base editor inhibits base escission repair of the edited strand. In some embodiments, the base editor protects or binds the non-edited strand. In some embodiments, the base editor comprises UGI activity. In some embodiments, the base editor comprises nickase activity. In some embodiments, the intended edited basepair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target windo is a deamination window In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited basepair, wherein the efficiency of generating the intended edited basepair is at least 5%. It should be appreciated that in some embodiments, step b is omitted. In some embodiments, at least 5% of the intended basepaires are edited. In some embodiments, at least 10%, 15%, 20%, 25%, 30%, 35%, 40%, 45%, or 50% of the intended basepaires are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is cytosine. In some embodiments, the second nucleobase is not G, C, A, or T. In some embodiments, the second base is uracil. In some embodiments, the base editor inhibits base escission repair of the edited strand. In some embodiments, the base editor protects or binds the non-edited strand. In some embodiments, the nucleobase editor comprises UGI activity. In some embodiments, the nucleobase edit comprises nickase activity. In some embodiments, the intended edited basepair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Kits, Vectors, Cells

Some aspects of this disclosure provide kits comprising a nucleic acid construct, comprising (a) a nucleotide sequence encoding a Cas9 protein or a Cas9 fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a Cas9 protein of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising a Cas9 protein, a fusion protein, a nucleic acid molecule encoding the fusion protein, a complex comprise the Cas9 protein and the gRNA, and/or a vector as provided herein.

The description of exemplary embodiments of the reporter systems above is provided for illustration purposes only and not meant to be limiting. Additional reporter systems, e.g., variations of the exemplary systems described in detail above, are also embraced by this disclosure.

EXAMPLES

Example 1

Cas9 Deaminase Fusion Proteins

A number of Cas9:Deaminase fusion proteins were generated and deaminase activity of the generated fusions was characterized. The following deaminases were tested:
Human AID (hAID):

(SEQ ID NO: 607)
MDSLLMNRRKFLYQFKNVRWAKGRRETYLCYVVKRRDSATSFSLDFGYLRN

KNGCHVELLFLRYISDWDLDPGRCYRVTWFTSWSPCYDCARHVADFLRGNP

YLSLRIFTARLYFCEDRKAEPEGLRRLHRAGVQIAIMTFKDYFYCWNTFVE

NHERTFKAWEGLHENSVRLSRQLRRILLPLYEVDDLRDAFRTLGLLD

Human AID-DC (hAID-DC, truncated version of hAID with 7-fold increased activity):

(SEQ ID NO: 608)
MDSLLMNRRKFLYQFKNVRWAKGRRETYLCYVVKRRDSATSFSLDFGYL

RNKNGCHVELLFLRYISDWDLDPGRCYRVTWFTSWSPCYDCARHVADFL

RGNPNLSLRIFTARLYFCEDRKAEPEGLRRLHRAGVQIAIMTFKDYFYC

WNTFVENHERTFKAWEGLHENSVRLSRQLRRILL

Rat APOBEC1 (rAPOBEC1):

(SEQ ID NO: 284)
MSSETGPVAVDPTLRRRIEPHEFEVFFDPRELRKETCLLYEINWGGRHS

IWRHTSQNTNKHVEVNFIEKFTTERYFCPNTRCSITWFLSWSPCGECSR

AITEFLSRYPHVTLFIYIARLYHHADPRNRQGLRDLISSGVTIQIMTEQ

ESGYCWRNFVNYSPSNEAHWPRYPHLWVRLYVLELYCIILGLPPCLNIL

RRKQPQLTFFTIALQSCHYQRLPPHILWATGLK

Human APOBEC1 (hAPOBEC1)

(SEQ ID NO: 5724)
MTSEKGPSTGDPTLRRRIEPWEFDVFYDPRELRKEACLLYEIKWGMSRK

IWRSSGKNTTNHVEVNFIKKFTSERDFHPSMSCSITWFLSWSPCWECSQ

AIREFLSRHPGVTLVIYVARLFWHMDQQNRQGLRDLVNSGVTIQIMRAS

EYYHCWRNFVNYPPGDEAHWPQYPPLWMMLYALELHCIILSLPPCLKIS

RRWQNHLTFFRLHLQNCHYQTIPPHILLATGLIHPSVAWR

*Petromyzon marinus* (Lamprey) CDA1 (pmCDA1):

(SEQ ID NO: 609)
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV

Human APOBEC3G (hAPOBEC3G):

(SEQ ID NO: 610)
MELKYHPEMRFFHWFSKWRKLHRDQEYEVTWYISWSPCTKCTRDMATFLA

EDPKVTLTIFVARLYYFWDPDYQEALRSLCQKRDGPRATMKIMNYDEFQH

CWSKFVYSQRELFEPWNNLPKYYILLHIMLGEILRHSMDPPTFTFNFNNE

PWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQ

PWDGLDEHSQDLSGRLRAILQNQEN

Deaminase Activity on ssDNA. A USER (Uracil-Specific Excision Reagent) Enzyme-based assay for deamination was employed to test the activity of various deaminases on single-stranded DNA (ssDNA) substrates. USER Enzyme was obtained from New England Biolabs. An ssDNA substrate was provided with a target cytosine residue at different positions. Deamination of the ssDNA cytosine target residue results in conversion of the target cytosine to a uracil. The USER Enzyme excises the uracil base and cleaves the ssDNA backbone at that position, cutting the ssDNA substrate into two shorter fragments of DNA. In some assays, the ssDNA substrate is labeled on one end with a dye, e.g., with a 5' Cy3 label (the * in the scheme below). Upon deamination, excision, and cleavage of the strand, the substrate can be subjected to electrophoresis, and the substrate and any fragment released from it can be visualized by detecting the label. Where Cy5 is images, only the fragment with the label will be visible via imaging.

In one USER Enzyme assay, ssDNA substrates were used that matched the target sequences of the various deaminases tested. Expression cassettes encoding the deaminases tested were inserted into a CMV backbone plasmid that has been used previously in the lab (Addgene plasmid 52970). The deaminase proteins were expressed using a TNT Quick Coupled Transcription/Translation System (Promega) according to the manufacturers recommendations. After 90 min of incubation, 5 mL of lysate was incubated with 5' Cy3-labeled ssDNA substrate and 1 unit of USER Enzyme (NEB) for 3 hours. The DNA was resolved on a 10% TBE PAGE gel and the DNA was imaged using Cy-dye imaging.

A schematic representation of the USER Enzyme assay is shown in FIG. 41.

Figure 1:
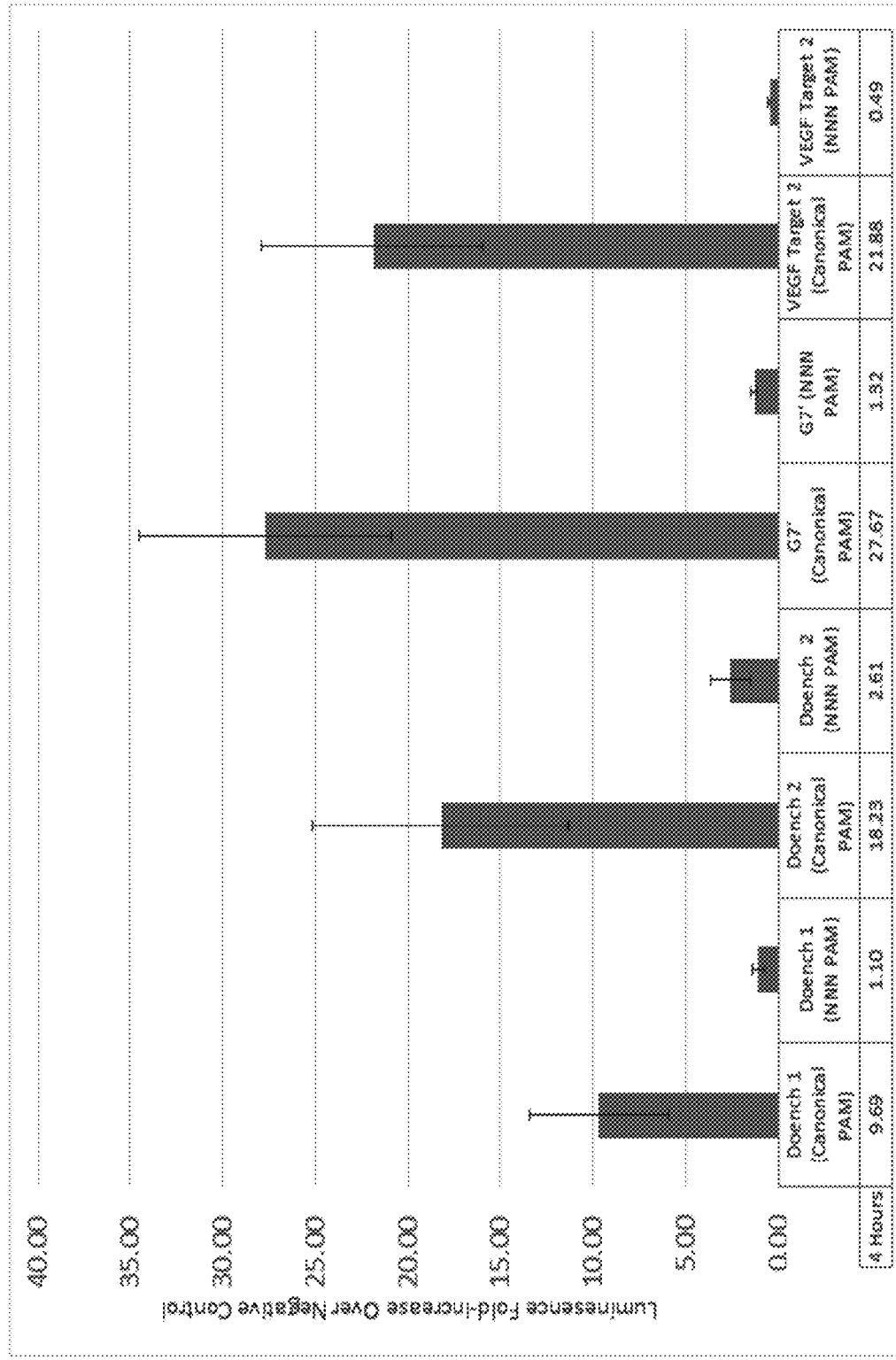
FIG. 1 shows the deaminase activity of deaminases on single stranded DNA substrates. Single stranded DNA substrates using randomized PAM sequences (NNN PAM) were used as negative controls. Canonical PAM sequences used (NGG PAM)

FIG. 1 shows the deaminase activity of the tested deaminases on ssDNA substrates, such as Doench 1, Doench 2, G7' and VEGF Target 2. The rAPOBEC1 enzyme exhibited a substantial amount of deamination on the single-stranded DNA substrate with a canonical NGG PAM, but not with a negative control non-canonical NNN PAM. Cas9 fusion proteins with APOBEC family deaminases were generated. The following fusion architectures were constructed and tested on ssDNA:

(SEQ ID NO: 611)
rAPOBEC1-GGS-dCas9 primary sequence

MSSETGPVAVDPTLRRRIEPHEFEVFFDPRELRKETCLLYEINWGGRHSIWRHTSQNT

NKHVEVNFIEKFTTERYFCPNTRCSITWFLSWSPCGECSRAITEFLSRYPHVTLFIYIAR

LYHHADPRNRQGLRDLISSGVTIQIMTEQESGYCWRNFVNYSPSNEAHWPRYPHLW

VRLYVLELYCIILGLPPCLNILRRKQPQLTFFTIALQSCHYQRLPPHILWATGLKGGSD

KKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHP

IFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEK

KNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANR

NFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQ

LQNEKLYLYYLQNGRDMYVDQELDINRLSDYDVDAIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYDVR

EINNYHHAHDAYLNAVVGTALIKKYPKLESEFVYGDYKVYDVRKMIAKSEQEIGKAT

AKYFFYSNIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKLPKYSLFELE

NGRKRMLASAGELQKGNELALPSKYVNFLYLASHYEKLKGSPEDNEQKQLFVEQHK

NGRKRMLASAGELQKGNELALPSKYVNFLYLASHYEKLKGSPEDNEQKQLFVEQHK rAPOBEC1-(GGS)₃-dCas9 primary sequence (SEQ ID NO: 612)

MSSETGPVAVDPTLRRRIEPHEFEVFFDPRELRKETCLLYEINWGGRHSIWRHTSQNT
NKHVEVNFIEKFTTERYFCPNTRCSITWFLSWSPCGECSRAITEFLSRYPHVTLFIYIAR
LYHHADPRNRQGLRDLISSGVTIQIMTEQESGYCWRNFVNYSPSNEAHWPRYPHLW
VRLYVLELYCIILGLPPCLNILRRKQPQLTFFTIALQSCHYQRLPPHILWATGLKGGSG
GSGGSMDKKYSIGLAIGTNSVGWAVITDEYKVPSKKFKVLGNTDRHSIKKNLIGALLF
DSGETAEATRLKRTARRRYTRRKNRICYLQEIFSNEMAKVDDSFFHRLEESFLVEED
KKHERHPIFGNIVDEVAYHEKYPTIYHLRKKLVDSTDKADLRLIYLALAHMIKFRGH
FLIEGDLNPDNSDVDKLFIQLVQTYNQLFEENPINASGVDAKAILSARLSKSRRLENLI
AQLPGEKKNGLFGNLIALSLGLTPNFKSNFDLAEDAKLQLSKDTYDDDLDNLLAQIG
DQYADLFLAAKNLSDAILLSDILRVNTEITKAPLSASMIKRYDEHHQDLTLLKALVRQ
QLPEKYKEIFFDQSKNGYAGYIDGGASQEEFYKFIKPILEKMDGTEELLVKLNREDLL
RKQRTFDNGSIPHQIHLGELHAILRRQEDFYPFLKDNREKIEKILTFRIPYYVGPLAR
GNSRFAWMTRKSEETITPWNFEEVVDKGASAQSFIERMTNFDKNLPNEKVLPKHSL
LYEYFTVYNELTKVKYVTEGMRKPAFLSGEQKKAIVDLLFKTNRKVTVKQLKEDYFK
KIECFDSVEISGVEDRFNASLGTYHDLLKIIKDKDFLDNEENEDILEDIVLTLTLFEDR
EMIEERLKTYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKKGILQTVKV
VDELVKVMGRHKPENIVIEMARENQTTQKGQKNSRERMKRIEEGIKELGSQILKEHP
VENTQLQNEKLYLYYLQNGRDMYVDQELDINRLSDYDVDAIVPQSFLKDDSIDNKVL
TRSDKNRGKSDNVPSEEVVKKMKNYWRQLLNAKLITQRKFDNLTKAERGGLSELDK
AGFIKRQLVETRQITKHVAQILDSRMNTKYDENDKLIREVKVITLKSKLVSDFRKDFQ
FYKVREINNYHHAHDAYLNAVVGTALIKKYPKLESEFVYGDYKVYDVRKMIAKSEQE
IGKATAKYFFYSNIMNFFKTEITLANGEIRKRPLIETNGETGEIVWDKGRDFATVRKV
LSMPQVNIVKKTEVQTGGFSKESILPKRNSDKLIARKKDWDPKKYGGFDSPTVAYSVL
VVAKVEKGKSKKLKSVKELLGITIMERSSFEKNPIDFLEAKGYKEVKKDLIIKLPKYSL
FELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD dCas9-GGS-rAPOBEC1 (SEQ ID NO: 613)

DKKYSIGLAIGTNSVGWAVITDEYKVPSKKFKVLGNTDRHSIKKNLIGALLFDSGETA
EATRLKRTARRRYTRRKNRICYLQEIFSNEMAKVDDSFFHRLEESFLVEEDKKHERH
PIFGNIVDEVAYHEKYPTIYHLRKKLVDSTDKADLRLIYLALAHMIKFRGHFLIEGDL
NPDNSDVDKLFIQLVQTYNQLFEENPINASGVDAKAILSARLSKSRRLENLIAQLPGE
KKNGLFGNLIALSLGLTPNFKSNFDLAEDAKLQLSKDTYDDDLDNLLAQIGDQYADL
FLAAKNLSDAILLSDILRVNTEITKAPLSASMIKRYDEHHQDLTLLKALVRQQLPEKY

```
KEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRF

AWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIECF

DSVEISGVEDRFNASLGTYHDLLKIIKDKDFLDNEENEDILEDIVLTLTLFEDREMIE

ERLKTYAHLFDDKVMKQLRRRYTGWGRLSRKLINGIRDKQSGKTILDFLKSDGFAN

RNFMQLIHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKEHPVENT

QLQNEKLYLYYLQNGRDMYVDQELDINRLSDYDVDAIVPQSFLKDDSIDNKVLTRSD

KNRGKSDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKLPKYSLFELE

NGRKRMLASAGELQKGNELALPSKYVNFLYLASHYEKLKGSPEDNEQKQLFVEQHK

HYLDEIIEQISEFSKRVILADANLDKVLSAYNKHRDKPIREQAENIIHLFTLTNLGAPA

AFKYFDTTIDRKRYTSTKEVLDATLIHQSITGLYETRIDLSQLGGD GGS MSSETGPVA

VDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPR

NRQGLRDLISSGVTIQIMTEQESGYCWRNFVNYSPSNEAHWPRYPHLWVRLYVLEL

YCIILGLPPCLNILRRKQPQLTFFTIALQSCHYQRLPPHILWATGLK (SEQ ID NO: 614)
dCAS9- GGS₃ -rAPOBEC1

DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRF

AWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIECF

DSVEISGVEDRFNASLGTYHDLLKIIKDKDFLDNEENEDILEDIVLTLTLFEDREMIE

ERLKTYAHLFDDKVMKQLRRRYTGWGRLSRKLINGIRDKQSGKTILDFLKSDGFAN
```

-continued

RNFMQLIHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKEHPVENT

QLQNEKLYLYYLQNGRDMYVDQELDINRLSDYDVDAIVPQSFLKDDSIDNKVLTRSD

KNRGKSDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKLPKYSLFELE

NGRKRMLASAGELQKGNELALPSKYVNFLYLASHYEKLKGSPEDNEQKQLFVEQHK

HYLDEIIEQISEFSKRVILADANLDKVLSAYNKHRDKPIREQAENIIHLFTLTNLGAPA

AFKYFDTTIDRKRYTSTKEVLDATLIHQSITGLYETRIDLSQLGGD GGSGGSGGS MSS

ETGPVAVDPTLRRRIEPHEFEVFFDPRELRKETCLLYEINWGGRHSTWRHTSQNTNKH

VEVNFIEKFTTERYFCPNTRCSITWFLSWSPCGECSRAITEFLSRYPHVTLFIYIARLYH

HADPRNRQGLRDLISSGVTIQIMTEQESGYCWRNFVNYSPSNEAHWPRYPHLWVRL

YVLELYCIILGLPPCLNILRRKQPQLTFFTIALQSCHYQRLPPHILWATGLK (SEQ ID NO: 615)

rAPOBEC1- XTEN -dCas9 primary sequence

MSSETFPVAVDPTLRRRIEPHEFEVFFDPRELRKETCLLYEINWGGRHSIWRHTSQNT

NKHVEVNFIEKFTTERYFCPNTRCSITWFLSWSPCGECSRAITEFLSRYPHVTLFIYIAR

LYHHADPRNRQGLRDLISSGVTIQIMTEQESGYCWRNFVNYSPSNEAHWPRYPHLW

VRLYVLELYCIILGLPPCLNILRRKQPQLTFFTIALQSCHYQRLPPHILWATGLKS GSH

TPGTSESATPES DKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMIK

FRGHFLIEGDLNPDNSDVDKLFIQLVQTYNQLFEENPINASGVDAKAILSARLSKSRR

LENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLN

REDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVL

PKHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILD

FLKSDGFANRNFMQLIHDDSLTFKEDIQKAQVSGQGDSLHEHIANLAGSPAIKKGIL

-continued

QTVKVVDELVKVMGRHKPENIVIEMARENQTTQKGQKNSRERMKRIEEGIKELGSQI

LKEHPVENTQLQNEKLYLYYLQNGRDMYVDQELDINRLSDYDVDAIVPQSFLKDDSI

DNKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKMIA

KSEQEIGKATAKYFFYSNIMNFFKTEITLANGEIRKRPLIETNGETGEIVWDKGRDFA

TVRKVLSMPQVNIVKKTEVQTGGFSKESILPKRNSDKLIARKKDWDPDDYGGFDSPT

VAYSVLVVAKVEKGKSKKLKSVKELLGITIMERSSFEKNPIDFLEAKGYKEVKKDLIIK

VAYSVLVVAKVEKGKSKKLKSVKELLGITIMERSSFEKNPIDFLEAKGYKEVKKDLIIK

LPKYSLFELENGRKRMLASAGELQKGNELALPSKYVNFLYLASHYEKLKGSPEDNEQ

KQLFVEQHKHYLDEIIEQISEFSKRVILADANLDKVLSAYNKHRDKPIREQAENIIHLF

TLTNLGAPAAFKYFDTTIDRKRYTSTKEVLDATLIHQSITGLYETRIDLSQLGGD

Figure 2:
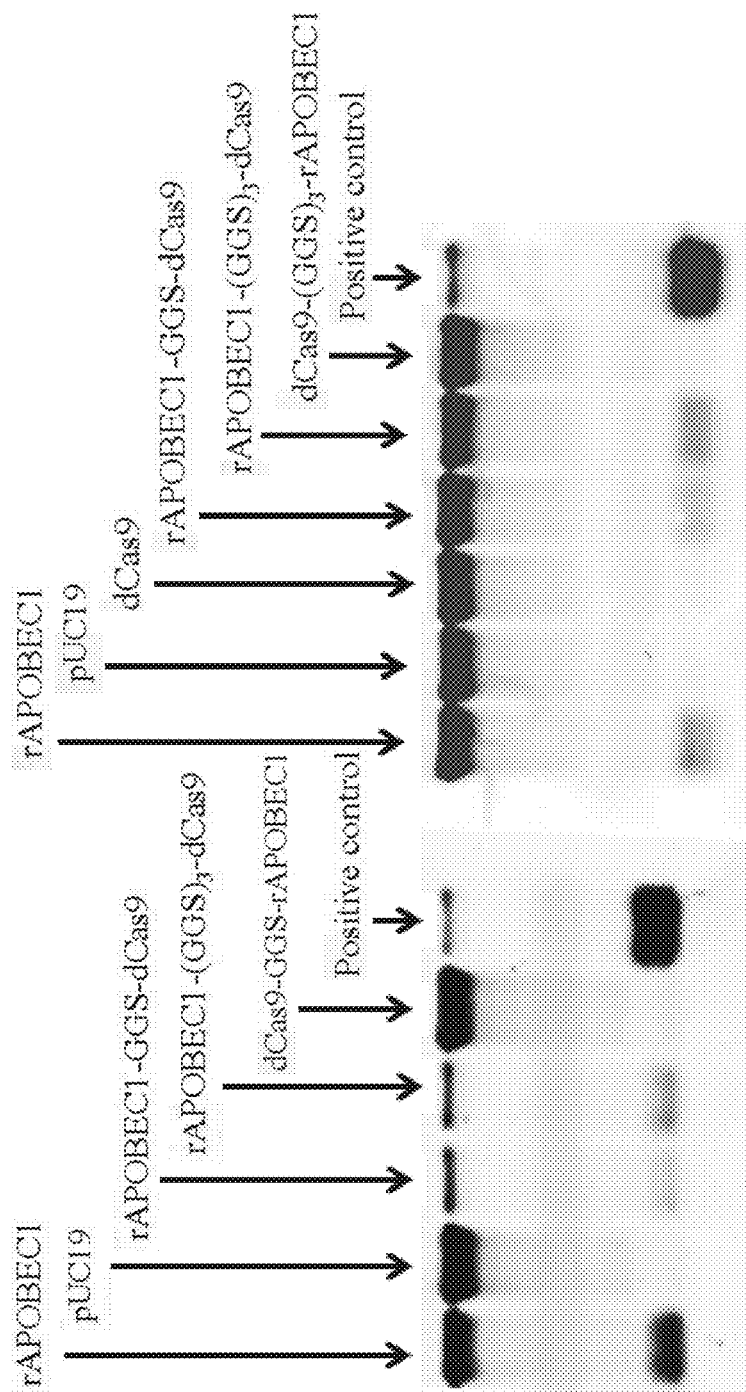
FIG. 2 shows activity of Cas9:deaminase fusion proteins on single stranded DNA substrates. (GGS)$_3$ corresponds to SEQ ID NO: 596.

FIG. 2 shows that the N-terminal deaminase fusions showed significant activity on the single stranded DNA substrates. For this reason, only the N-terminal architecture was chosen for further experiments.

FIG. 3 illustrates double stranded DNA substrate binding by deaminase-dCas9:sgRNA complexes. A number of double stranded deaminase substrate sequences were generated. The sequences are provided below. The structures according to FIG. 3 are identified in these sequences (36 bp: underlined, sgRNA target sequence: bold; PAM: boxed; 21 bp: italicized). All substrates were labeled with a 5'-Cy3 label:

(SEQ ID NO: 616)
2: GTAGGTAGTTAGGATGAATGGAAGGTTGGTATAGTCCCGCGGATTTATTTATTT

AATGG*ATGACCTCTGGATCCATGGAC*-3'

(SEQ ID NO: 617)
3: GTAGGTAGTTAGGATGAATGGAAGGTTGGTATAGCTTCCGCGGATTTATTTATT

TATGG*ATGACCTCTGGATCCATGGAC*-3'

(SEQ ID NO: 618)
4: GTAGGTAGTTAGGATGAATGGAAGGTTGGTATAGCCTTCCGCGGATTTATTTAT

TATGG*ATGACCTCTGGATCCATGGAC*-3'

(SEQ ID NO: 619)
5: GTAGGTAGTTAGGATGAATGGAAGGTTGGTATAGCCATTCCGCGGATTTATTTA

TTTGG*ATGACCTCTGGATCCATGGAC*-3'

(SEQ ID NO: 620)
6: GTAGGTAGTTAGGATGAATGGAAGGTTGGTATAGCCTATTCCGCGGATTTATTT

ATTGG*ATGACCTCTGGATCCATGGAC*-3'

(SEQ ID NO: 621)
7: GTAGGTAGTTAGGATGAATGGAAGGTTGGTATAGCCTTATTCCGCGGATTTATT

TATGG*ATGACCTCTGGATCCATGGAC*-3'

-continued (SEQ ID NO: 622)
8: <u>GTAGGTAGTTAGGATGAATGGAAGGTTGGTATAGCC</u>ATTATTCCGCGGATTTAT

TT`TGG`*ATGACCTCTGGATCCATGGAC-3'*

(SEQ ID NO: 623)
9: <u>GTAGGTAGTTAGGATGAATGGAAGGTTGGTATAGCC</u>TATTATTCCGCGGATTTA

TT`TGG`*ATGACCTCTGGATCCATGGAC-3'*

(SEQ ID NO: 624)
10: <u>GTAGGTAGTTAGGATGAATGGAAGGTTGGTATAGCC</u>ATTATATTCCGCGGATTT

AT`TGG`*ATGACCTCTGGATCCATGGAC-3'*

(SEQ ID NO: 625)
11: <u>GTAGGTAGTTAGGATGAATGGAAGGTTGGTATAGCC</u>TATTATATTCCGCGGATT

TA`TGG`*ATGACCTCTGGATCCATGGAC-3'*

(SEQ ID NO: 626)
12: <u>GTAGGTAGTTAGGATGAATGGAAGGTTGGTATAGCC</u>TTATTATATTCCGCGGAT

TT`TGG`*ATGACCTCTGGATCCATGGAC-3'*

(SEQ ID NO: 627)
13: <u>GTAGGTAGTTAGGATGAATGGAAGGTTGGTATAGCC</u>ATTATTATATTCCGCGGA

TT`TGG`*ATGACCTCTGGATCCATGGAC-3'*

(SEQ ID NO: 628)
14: <u>GTAGGTAGTTAGGATGAATGGAAGGTTGGTATAGCC</u>TATTATTATATTCCGCGG

AT`TGG`*ATGACCTCTGGATCCATGGAC-3'*

(SEQ ID NO: 629)
15: <u>GTAGGTAGTTAGGATGAATGGAAGGTTGGTATAGCC</u>ATTATTATTATTACCGCG

GA`TGG`*ATGACCTCTGGATCCATGGAC-3'*

(SEQ ID NO: 630)
18: <u>GTAGGTAGTTAGGATGAATGGAAGGTTGGTATAGCC</u>ATTATTATTATTATTACC

GC`TGG`*ATGACCTCTGGATCCATGGAC-3'*

"—":

(SEQ ID NO: 631)
<u>GTAGGTAGTTAGGATGAATGGAAGGTTGGTATAGTA</u>ATATTAATTTATTTATTTAA

`TGG`*ATGACCTCTGGATCCATGGAC-3'*

(SEQ ID NO: 632)
8U: <u>GTAGGTAGTTAGGATGAATGGAAGGTTGGTGTAG</u>ATTATTATCUGCGGATTTA

T`TGG`*ATGACCTCTGGATCCATGGACAT-3'*

*In all substrates except for "8U", the top strand in FIG. 3 is the complement of the sequence specified here. In the case of "8U", there is a "G" opposite the U.

Figure 4:
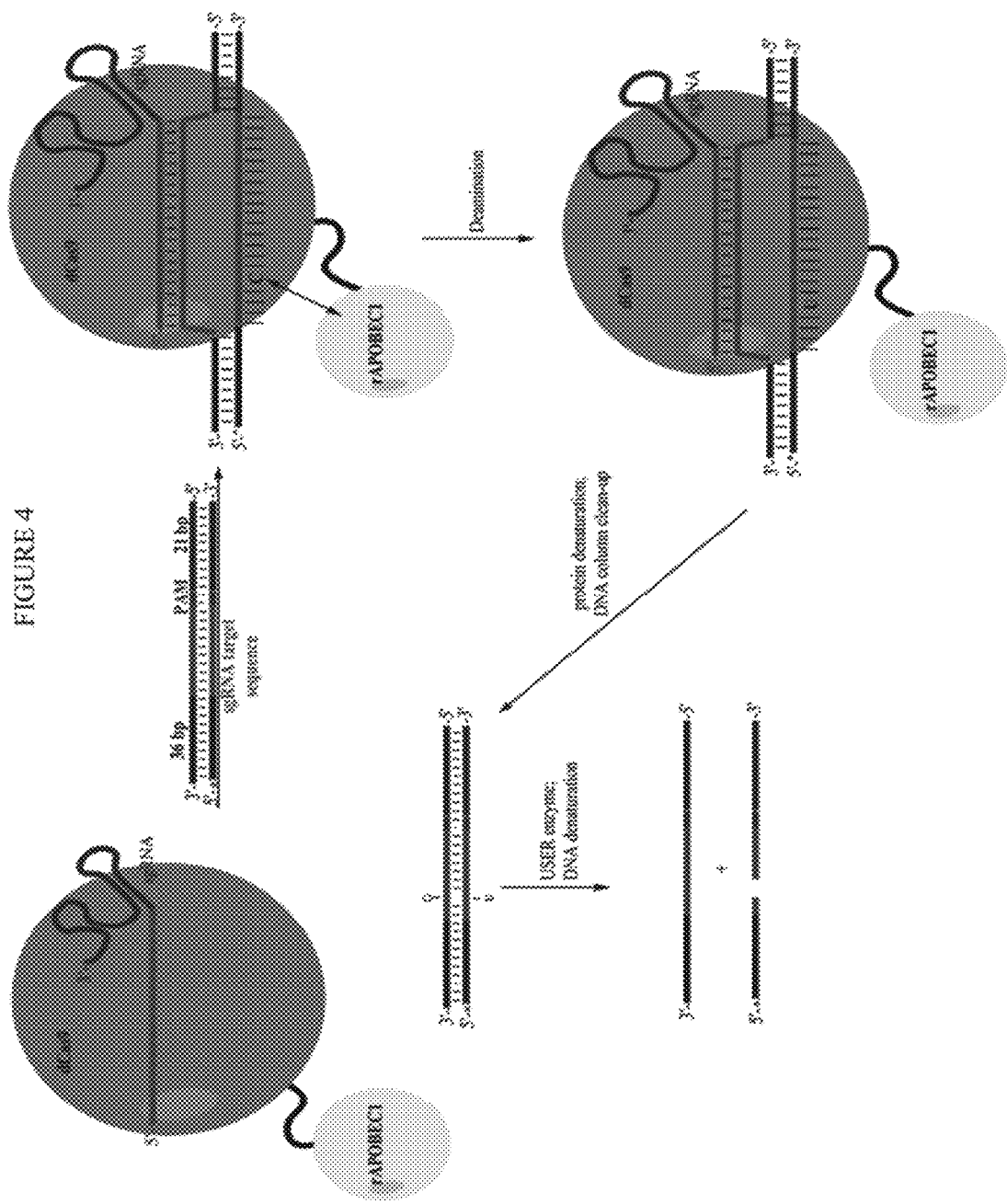
FIG. 4 illustrates a double stranded DNA deamination assay.

FIG. 4 shows the results of a double stranded DNA Deamination Assay. The fusions were expressed and purified with an N-terminal His6 tag via both Ni-NTA and sepharose chromatography. In order to assess deamination on dsDNA substrates, the various dsDNA substrates shown on the previous slide were incubated at a 1:8 dsDNA:fusion protein ratio and incubated at 37° C. for 2 hours. Once the dCas9 portion of the fusion binds to the DNA it blocks access of the USER enzyme to the DNA. Therefore, the fusion proteins were denatured following the incubation and the dsDNA was purified on a spin column, followed by incubation for 45 min with the USER Enzyme and resolution of the resulting DNA substrate and substrate fragments on a 10% TBE-urea gel.

Figure 5:
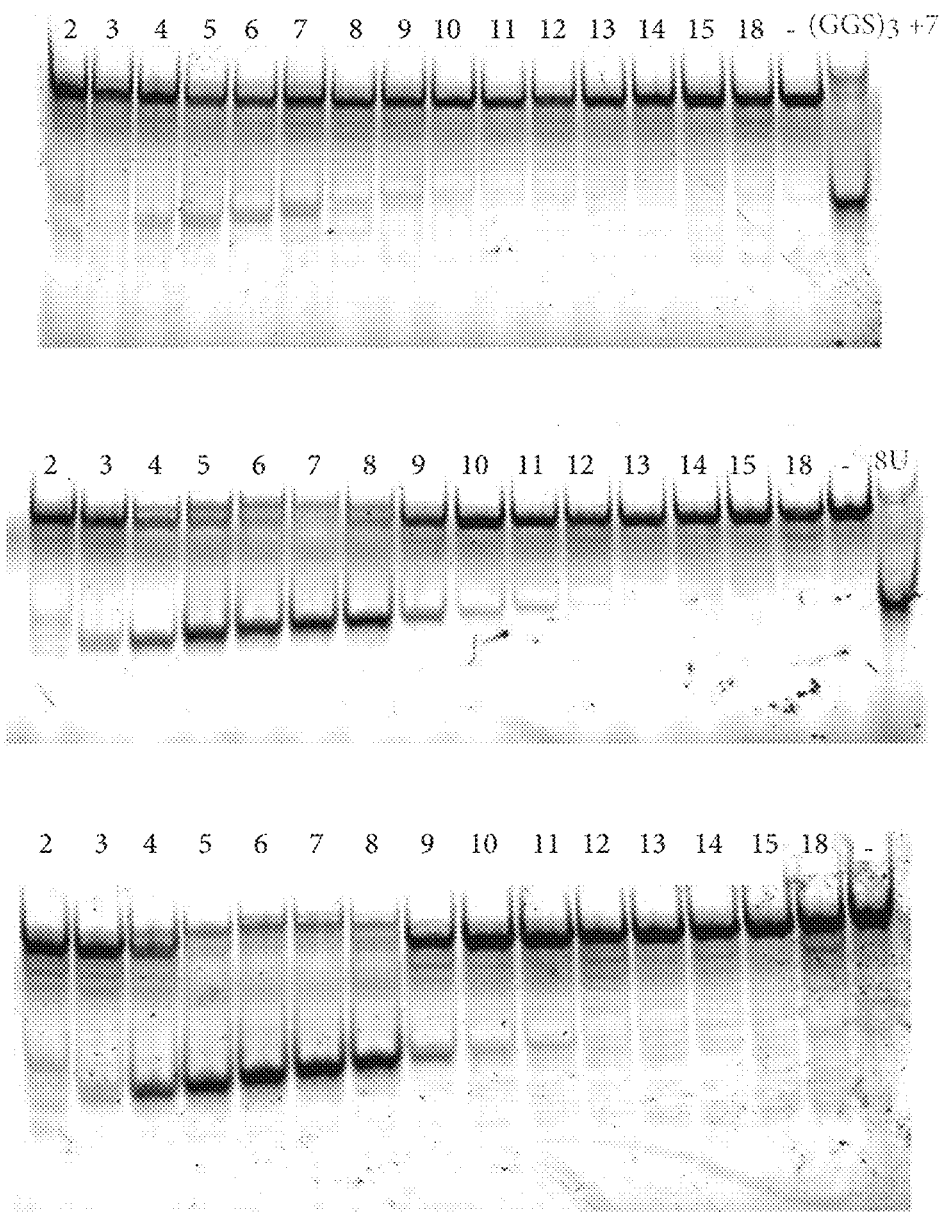
FIG. 5 demonstrates that Cas9 fusions can target positions 3-11 of double-stranded DNA target sequences (numbered according to the schematic in FIG. 5). Upper Gel: 1 μM rAPOBEC1-GGS-dCas9, 125 nM dsDNA, 1 equivalent sgRNA. Mid Gel: 1 μM rAPOBEC1-(GGS)$_3$(SEQ ID NO: 596)-dCas9, 125 nM dsDNA, 1 equivalent sgRNA. Lower Gel: 1.85 μM rAPOBEC1-XTEN-dCas9, 125 nM dsDNA, 1 equivalent sgRNA.

FIG. 5 demonstrates that Cas9 fusions can target positions 3-11 of double-stranded DNA target sequences (numbered according to the schematic in FIG. 3). Upper Gel: 1 μM rAPOBEC1-GGS-dCas9, 125 nM dsDNA, 1 eq sgRNA. Mid Gel: 1 μM rAPOBEC1-(GGS)$_3$-dCas9, 125 nM dsDNA, 1 eq sgRNA. Lower Gel: 1.85 μM rAPOBEC1-XTEN-dCas9, 125 nM dsDNA, 1 eq sgRNA. Based on the data from these gels, positions 3-11 (according to the numbering in FIG. 3) are sufficiently exposed to the activity of the deaminase to be targeted by the fusion proteins tested.

Access of the deaminase to other positions is most likely blocked by the dCas9 protein.

The data further indicates that a linker of only 3 amino acids (GGS) is not optimal for allowing the deaminase to access the single stranded portion of the DNA. The 9 amino acid linker [(GGS)$_3$] (SEQ ID NO: 596) and the more structured 16 amino acid linker (XTEN) allow for more efficient deamination.

Figure 6:
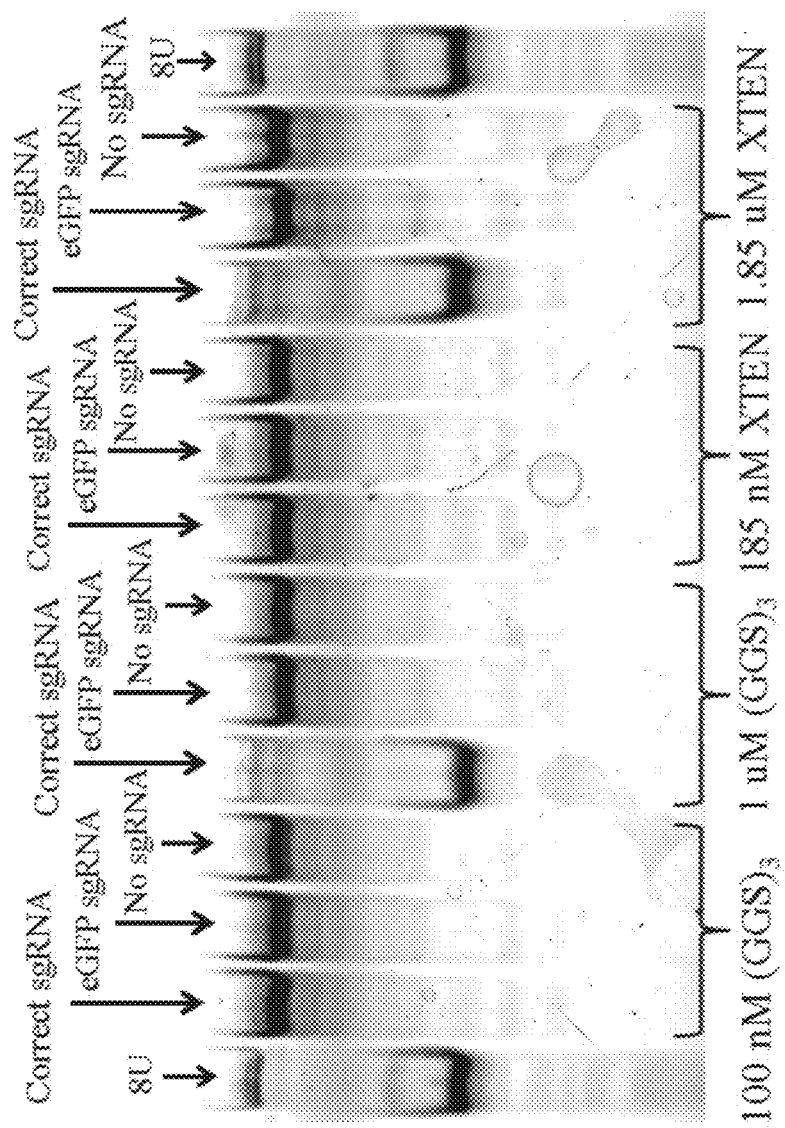
FIG. 6 demonstrates that the correct guide RNA, e.g., the correct sgRNA, is required for deaminase activity. (GGS)$_3$ corresponds to SEQ ID NO: 596.

FIG. 6 demonstrates that the correct guide RNA, e.g., the correct sgRNA, is required for deaminase activity. The gel shows that fusing the deaminase to dCas9, the deaminase enzyme becomes sequence specific (e.g., using the fusion with an eGFP sgRNA results in no deamination), and also confers the capacity to the deaminase to deaminate dsDNA. The native substrate of the deaminase enzyme is ssDNA, and no deamination occurred when no sgRNA was added. This is consistent with reported knowledge that APOBEC deaminase by itself does not deaminate dsDNA. The data indicates that Cas9 opens the double-stranded DNA helix within a short window, exposing single-stranded DNA that is then accessible to the APOBEC deaminase for cytidine deamination. The sgRNA sequences used are provided below. sequences (36 bp: underlined, sgRNA target sequence: bold; PAM: boxed; 21 bp: italicized)

```
DNA sequence 8:
                                    (SEQ ID NO:  633)
5'-Cy3-
GTAGGTAGTTAGGATGAATGGAAGGTTGGTATAGCCATTATTCCGCGGA

TTTATT

TTGGATGACCTCTGGATCCATGGAC-3'

(SEQ ID NO:  634)
Correct sgRNA sequence (partial 3' sequence):

5'-AUUAUUCCGCGGAUUUAUUUGUUUUAGAGCUAG...-3'

(SEQ ID NO:  635)
eGFP sgRNA sequence (partial 3'-sequence):
5'-CGUAGGCCAGGGUGGUCACGGUUUUAGAGCUAG...-3'
```

Example 2

Deamination of DNA Target Sequence

Figure 7:
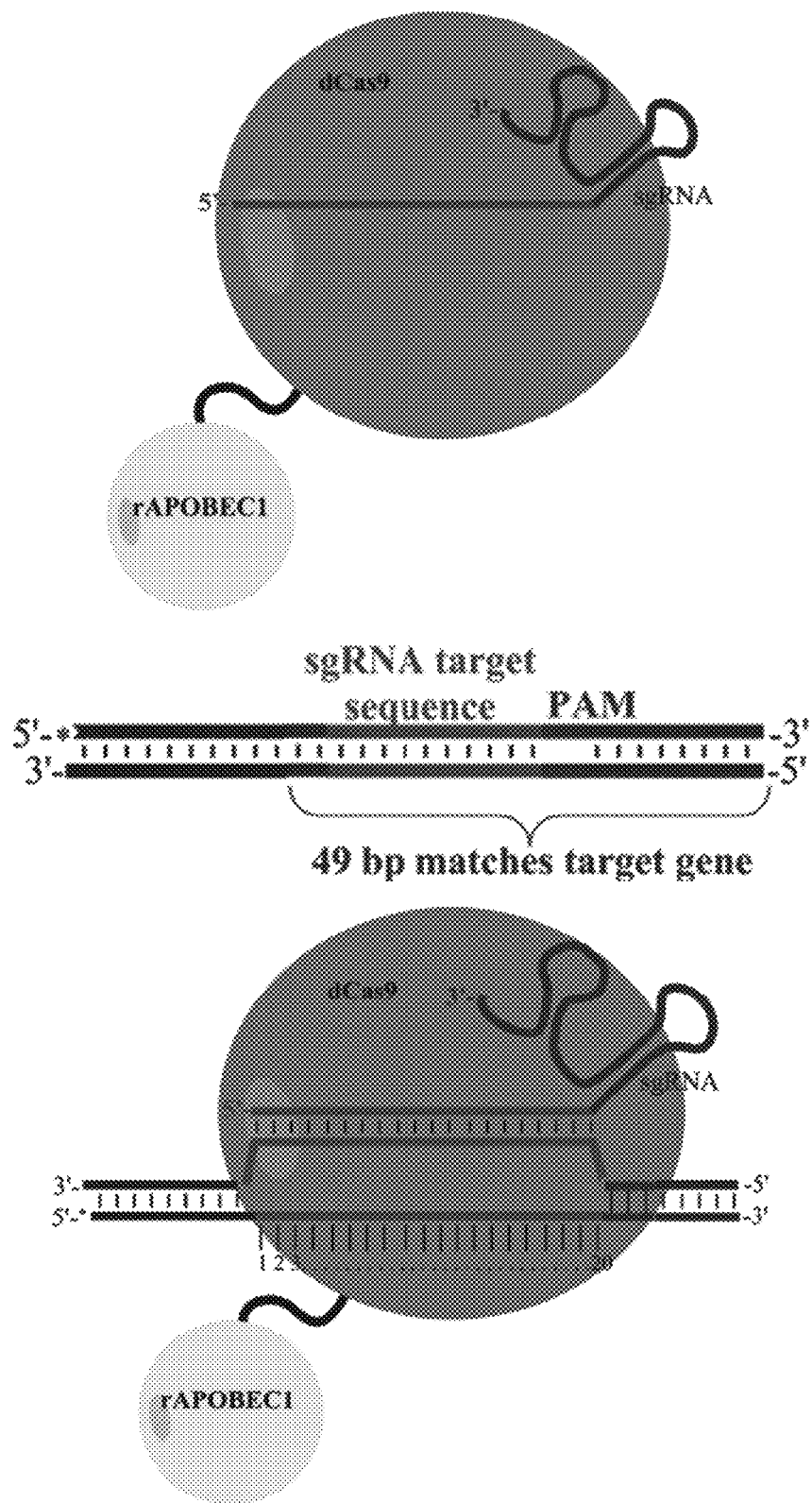
FIG. 7 illustrates the mechanism of target DNA binding of in vivo target sequences by deaminase-dCas9:sgRNA complexes.

Exemplary deamination targets. The dCas9:deaminase fusion proteins described herein can be delivered to a cell in vitro or ex vivo or to a subject in vivo and can be used to effect C to T or G to A transitions when the target nucleotide is in positions 3-11 with respect to a PAM. Exemplary deamination targets include, without limitation, the following: CCR5 truncations: any of the codons encoding Q93, Q102, Q186, R225, W86, or Q261 of CCR5 can be deaminated to generate a STOP codon, which results in a non-functional truncation of CCR5 with applications in HIV treatment. APOE4 mutations: mutant codons encoding C11R and C57R mutant APOE4 proteins can be deaminated to revert to the wild-type amino acid with applications in Alzheimer's treatment. eGFP truncations: any of the codons encoding Q158, Q184, Q185 can be deaminated to generate a STOP codon, or the codon encoding M1 can be deaminated to encode I, all of which result in loss of eGFP fluorescence, with applications in reporter systems. eGFP restoration: a mutant codon encoding T65A or Y66C mutant GFP, which does not exhibit substantial fluorescence, can be deaminated to restore the wild-type amino acid and confer fluorescence. PIK3CA mutation: a mutant codon encoding K111E mutant PIK3CA can be deaminated to restore the wild-type amino acid residue with applications in cancer. CTNNB1 mutation: a mutant codon encoding T41A mutant CTNNB1 can be deaminated to restore the wild-type amino acid residue with applications in cancer. HRAS mutation: a mutant codon encoding Q61R mutant HRAS can be deaminated to restore the wild-type amino acid residue with applications in cancer. P53 mutations: any of the mutant codons encoding Y163C, Y236C, or N239D mutant p53 can be deaminated to encode the wild type amino acid sequence with applications in cancer. The feasibility of deaminating these target sequences in double-stranded DNA is demonstrated in FIGS. 7 and 8. FIG. 7 illustrates the mechanism of target DNA binding of in vivo target sequences by deaminase-dCas9:sgRNA complexes.

Figure 8:
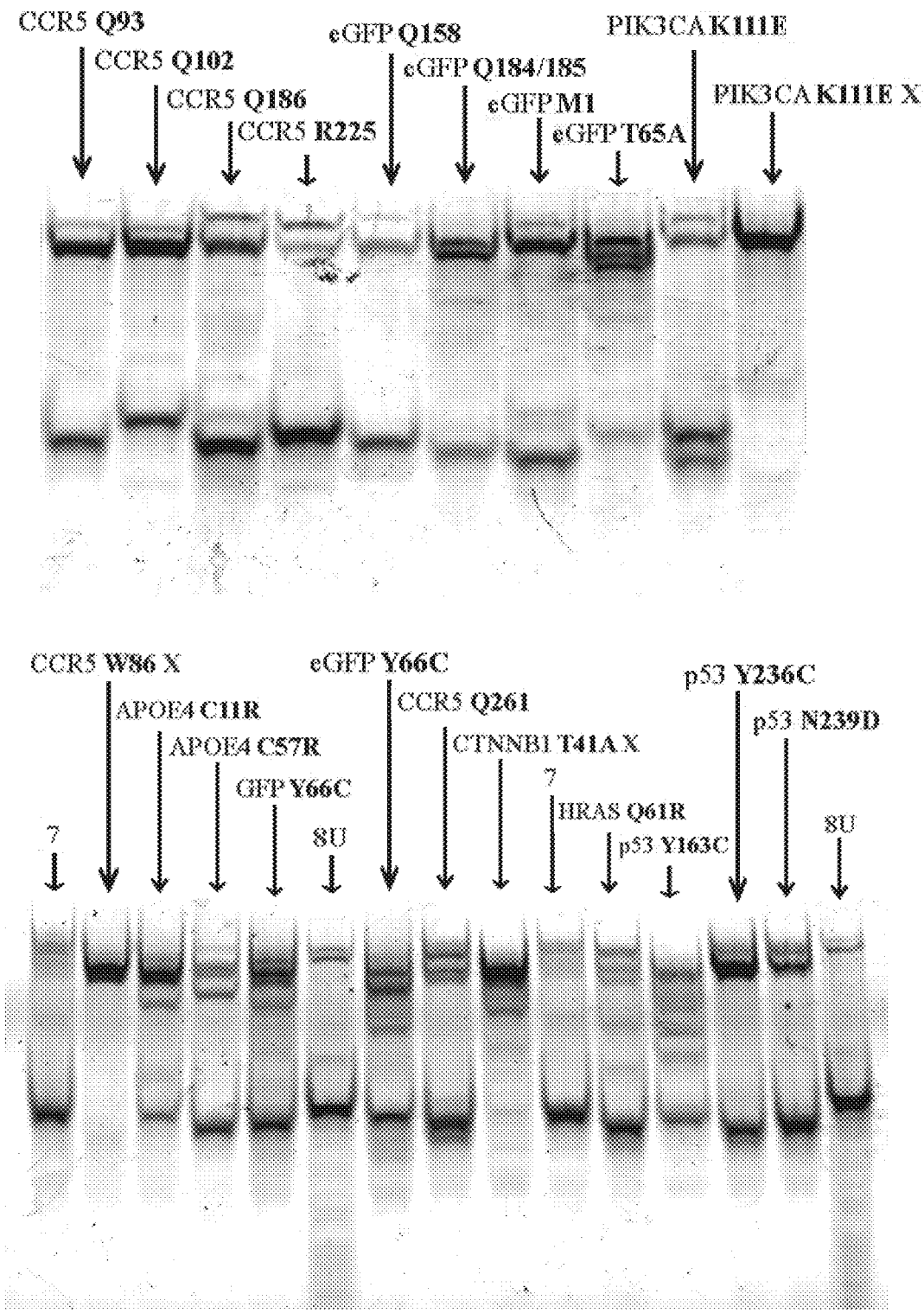
FIG. 8 shows successful deamination of exemplary disease-associated target sequences.

FIG. 8 shows successful deamination of exemplary disease-associated target sequences. Upper Gel: CCR5 Q93: coding strand target in pos. 10 (potential off-targets at positions 2, 5, 6, 8, 9); CCR5 Q102: coding strand target in pos. 9 (potential off-targets at positions 1, 12, 14); CCR5 Q186: coding strand target in pos. 9 (potential off-targets at positions 1, 5, 15); CCR5 R225: coding strand target in pos. 6 (no potential off-targets); eGFP Q158: coding strand target in pos. 5 (potential off-targets at positions 1, 13, 16); eGFP Q184/185: coding strand target in pos. 4 and 7 (potential off-targets at positions 3, 12, 14, 15, 16, 17, 18); eGFP M1: template strand target in pos. 12 (potential off-targets at positions 2, 3, 7, 9, 11) (targets positions 7 and 9 to small degree); eGFP T65A: template strand target in pos. 7 (potential off-targets at positions 1, 8, 17); PIK3CA K111E: template strand target in pos. 2 (potential off-targets at positions 5, 8, 10, 16, 17); PIK3CA K111E: template strand target in pos. 13 (potential off-targets at positions 11, 16, 19) X. Lower Gel: CCR5 W86: template strand target in pos. 2 and 3 (potential off-targets at positions 1, 13) X; APOE4 C11R: coding strand target in pos. 11 (potential off-targets at positions 7, 13, 16, 17); APOE4 C57R: coding strand target in pos. 5) (potential off-targets at positions 7, 8, 12); eGFP Y66C: template strand target in pos. 11 (potential off-targets at positions 1, 4, 6, 8, 9, 16); eGFP Y66C: template strand target in pos. 3 (potential off-targets at positions 1, 8, 17); CCR5 Q261: coding strand target in pos. 10 (potential off-targets at positions 3, 5, 6, 9, 18); CTNNB1 T41A: template strand target in pos. 7 (potential off-targets at positions 1, 13, 15, 16) X; HRAS Q61R: template strand target in pos. 6 (potential off-targets at positions 1, 2, 4, 5, 9, 10, 13); p53 Y163C: template strand target in pos. 6 (potential off-targets at positions 2, 13, 14); p53 Y236C: template strand target in pos. 8 (potential off-targets at positions 2, 4); p53 N239D: template strand target in pos. 4 (potential off-targets at positions 6, 8). Exemplary DNA sequences of disease targets are provided below (PAMs (5'-NGG-3') and target positions are boxed):

CCR5 Q93: 5'-Cy3-
<u>GTAGGTAGTTAGGATGAATGGAAGGTTGGTAACTAT</u>GCTGCCGCC
(SEQ ID NO: 636)

C̄AGTGGGACTTT̄ḠḠ AAATACAATGTGTCAACTCTT-3'

CCR5 Q102: 5'-Cy3-
<u>GTAGGTAGTTAGGATGAATGGAAGGTTGGTAAAATA</u>CAATGTGT
(SEQ ID NO: 637)

C̄AACTCTTGACAḠḠḠCTCTATTTTATAGGCTTCTTC-3'

CCR5 Q186: 5'-Cy3-
<u>GTAGGTAGTTAGGATGAATGGAAGGTTGGTATTTTC</u>CATACAGT
(SEQ ID NO: 638)

C̄AGTATCAATTCT̄ḠḠAAGAATTTCCAGACATTAAAG-3'

CCR5 R225: 5'-Cy3-
(SEQ ID NO: 639)

<u>GTAGGTAGTTAGGATGAATGGAAGGTTGGTAGCTTC</u>GGTGTC̄GA

AATGAGAAGAAGĀḠḠCACAGGGCTGTGAGGCTTATC-3'

CCR5 W86: 4'-Cy3-
(SEQ ID NO: 640)

<u>GTAGGTAGTTAGGATGAATGGAAGGTTGGTAGTGAGC̄C̄ĀGAAGG</u>

GGACAGTAAGAĀḠḠAAAAACAGGTCAGAGATGGCC-3'

CCR5 Q261: 5'-Cy3-
<u>GTAGGTAGTTAGGATGAATGGAAGGTTGGTATCCTG</u>AACACCTT
(SEQ ID NO: 641)

CCAGGAATTCTTT̄ḠḠCCTGAATAATTGCAGTAGCTC-3'

APOE4 C11R: 5'-Cy3-
<u>GTAGGTAGTTAGGATGAATGGAAGGTTGGTAGACAT</u>GGAGGAC
(SEQ ID NO: 642)

GTGC̄GCGGCCGCCT̄ḠḠTGCAGTACCGCGGCGAGGTGC-3'

APOE4 C57R: 5'-Cy3-
(SEQ ID NO: 643)

<u>GTAGGTAGTTAGGATGAATGGAAGGTTGGTACTGCA</u>GAAGC̄GC

CTGGCAGTGTACCĀḠḠCCGGGGCCCGCGAGGGCGCCG-3' eGFP Q158: 5'-Cy3-
(SEQ ID NO: 644)

<u>GTAGGTAGTTAGGATGAATGGAAGGTTGGTAGCCGA</u>CAAGC̄AGA

AGAACGGCATCAĀḠḠTGAACTTCAAGATCCGCCACA-3'

(SEQ ID NO: 645)

eGFP Q184/185: 5'-Cy3-<u>GTAGGTAGTTAGGATGAATGGAAGGTTGGTAACCAC</u>TACC̄

AGC̄AGAACACCCCCATT̄ḠḠCGACGGCCCCGTGCTGCTGCC-3'

-continued (SEQ ID NO: 646)
eGFP M1: 5'-Cy3-
<u>GTAGGTAGTTAGGATGAATGGAAGGTTGGTACCTCG</u>CCCTTGCTCA

CC̄ATCTCGAGTC̄ḠḠCCGCCAGTGTGATGGATATCT-3'

(SEQ ID NO: 647)
eGFP T65A: 5'-Cy3-
<u>GTAGGTAGTTAGGATGAATGGAAGGTTGGTACACGC</u>GTAGGC̄CA

GGGTGGTCACGĀḠḠGTGGGCCAGGGCACGGGCAGC-3'

(SEQ ID NO: 648)
eGFP Y66C: 5'-Cy3-
<u>GTAGGTAGTTAGGATGAATGGAAGGTTGGTAAAGCA</u>CTGCACTC

CGCAGGTCAGGGT̄ḠḠTCACGAGGGTTGGCCAGGGCA-3'

(SEQ ID NO: 649)
eGFP Y66C: 5'-Cy3-
<u>GTAGGTAGTTAGGATGAATGGAAGGTTGGTACACTCCGC̄AGGTC</u>

AGGGTGGTCACGĀḠḠGTTGGCCAGGGCACGGGCAGG-3'

(SEQ ID NO: 650)
PIK3CA K111E: 5'-Cy3-
<u>GTAGGTAGTTAGGATGAATGGAAGGTTGGTAGGATCTC̄TTC</u>

TTCACGGTTGCCTACT̄ḠḠTTCAATTACTTTTAAAAATGG-3'

(SEQ ID NO: 651)
PIK3CA K111E: 5'-Cy3-
<u>GTAGGTAGTTAGGATGAATGGAAGGTTGGTATTCTC</u>GATTG

AGGATCTC̄TTCTTCAC̄ḠḠTTGCCTACTGGTTCAATTACT-3'

(SEQ ID NO: 652)
CTNNB1 T41A: 5'-Cy3-
<u>GTAGGTAGTTAGGATGAATGGAAGGTTGGTAAGGAG</u>CTGTGG

C̄AGTGGCACCAGAAT̄ḠḠATTCCAGAGTCCAGGTAAGAC-3'

(SEQ ID NO: 653)
HrAS Q61R: 5'-Cy3-
<u>GTAGGTAGTTAGGATGAATGGAAGGTTGGTAGTACT</u>CCTCCC̄GG

CCGGCGGTATCCĀḠḠATGTCCAACAGGCACGTCTCC-3'

(SEQ ID NO: 654)
p53 Y163C: 5'-Cy3-
<u>GTAGGTAGTTAGGATGAATGGAAGGTTGGTATGACT</u>GCTTGC̄AG

ATGGCCATGGCGC̄ḠḠACGCGGGTGCCGGGCGGGGT-3'
(SEQ ID NO: 654)

p53 Y236C: 5'-Cy3-

<u>GTAGGTAGTTAGGATGAATGGAAGGTTGGTACTGTT</u>ACACATGC (SEQ ID NO: 655)

AGTTGTAGTGGA`TGG`*TGGTACAGTCAGAGCCAACCT*-3'
(SEQ ID NO: 655)

p3 N239D: 5'-Cy3- (SEQ ID NO: 656)

<u>GTAGGTAGTTAGGATGAATGGAAGGTTGGTAGGAAC</u>TGTCACAC

ATGTAGTTGTAG`TGG`*ATGGTGGTACAGTCAGAGCCA*-3'

Example 3

Uracil Glycosylase Inhibitor Fusion Improves Deamination Efficiency

Direct programmable nucleobase editing efficiencies in mammalian cells by dCas9:deaminase fusion proteins can be improved significantly by fusing a uracil glycosylase inhibitor (UGI) to the dCas9:deaminase fusion protein.

Figure 9:
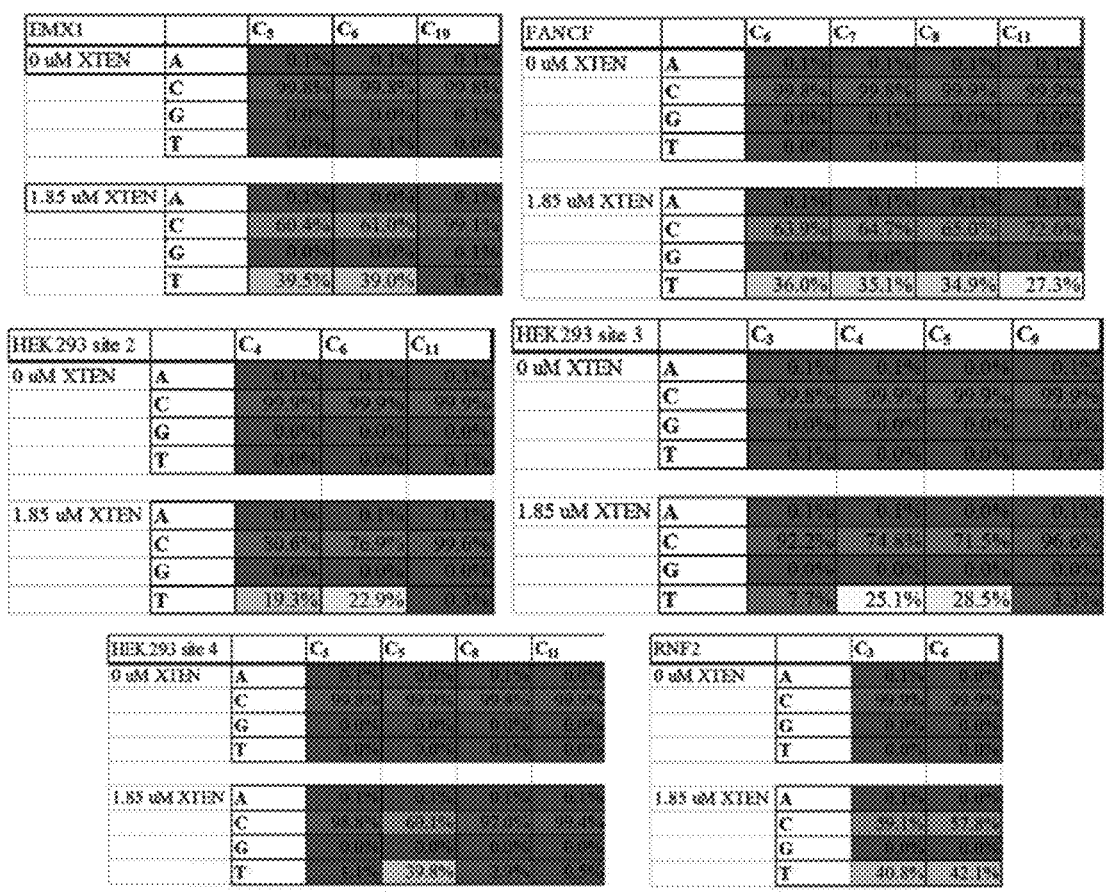
FIG. 9 shows in vitro C→T editing efficiencies using His6-rAPOBEC1-XTEN-dCas9.

FIG. 9 shows in vitro C→T editing efficiencies in human HEK293 cells using rAPOBEC1-XTEN-dCas9:

(SEQ ID NO: 657)

<u>rAPOBEC1</u>-XTEN-`dCAS9`-*NLS* primary sequence

MSSETGPVAVDPTLRRIEPHEFEVFFDPRELRKETCLLYEINWGGRHSIWRHTSQNT

NKHVEVNFIEKFTTERYFCPNTRCSITWFLSWSPCGECSRAITEFLSRYPHVTLFIYIAR

LYHHADPRNRQGLRDLISSGVTIQIMTEQESGYCWRNFVNYSPSNEAHWPRYPHLWV

RLYVLELYCIILGLPPCLNILRRKQPQLTFFTIALQSCHYQRLPPHILWATGLKSGSETP

GTSESATPESDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFFHRLEESFLV

EEDKKHERHPIFGNIVDEVAYHEKYPTIYHLRKKLVDSTDKADLRLIYLALAHMIKFR

GHFLIEGDLNPDNSDVDKLFIQLVQTYNQLFEENPINASGVDAKAILSARLSKSRRLE

NLIAQLPGEKKNGLFGNLIALSLGLTPNFKSNFDLAEDAKLQLSKDTYDDDLDNLLA

QIGDQYADLFLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEELLVKLNRED

LLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLL

YEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDRE

MIEERLKTYAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVE

NTQLQNEKLYLYYLQNGRDMYVDQELDINRLSDYDVDAIVPQSFLKDDSIDNKVLT

RSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQ

-continued

FYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKV

LSMPQVNIVKKTEVQTGGFSKESILPKRNSDKLIARKKDWDPKKYGGFDSPTVAYSV

LVVAKVEKGKSKKLKSVDELLGITIMERSSFEKNPIDFLEAKGYKEVKKDLIIKLPKYS

LFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIHLFTLTNL

KV

Protospacer sequences were as follows:

| | |
|---|---|
| EMX1: | 5'-GAGTC₅C₆GAGC₁₀AGAAGAAGAA[GGG]-3' (SEQ ID NO: 293) |
| FANCF: | 5'-GGAATC₆C₇C₈TTC₁₁TGCAGCACC[TGG]-3' (SEQ ID NO: 294) |
| HEK293 site 2: | 5'-GAAC₄AC₆AAAGC₁₁ATAGACTGC[GGG]-3' (SEQ ID NO: 295) |
| HEK293 site 3: | 5'-GGC₃C₄C₅AGAC₉TGAGCACGTGA[TGG]-3' (SEQ ID NO: 296) |
| HEK293 site 4: | 5'-GGC₃AC₅TGC₈GGC₁₁TGGAGGTGC[GGG]' (SEQ ID NO: 297) |
| RNF2: | 5'-GTC₃ATC₆TTAGTCATTACCTG[AGG]-3' (SEQ ID NO: 298) |

*PAMs are boxed, C residues within target window (positions 3-11) are numbered and bolded.

Figure 10:
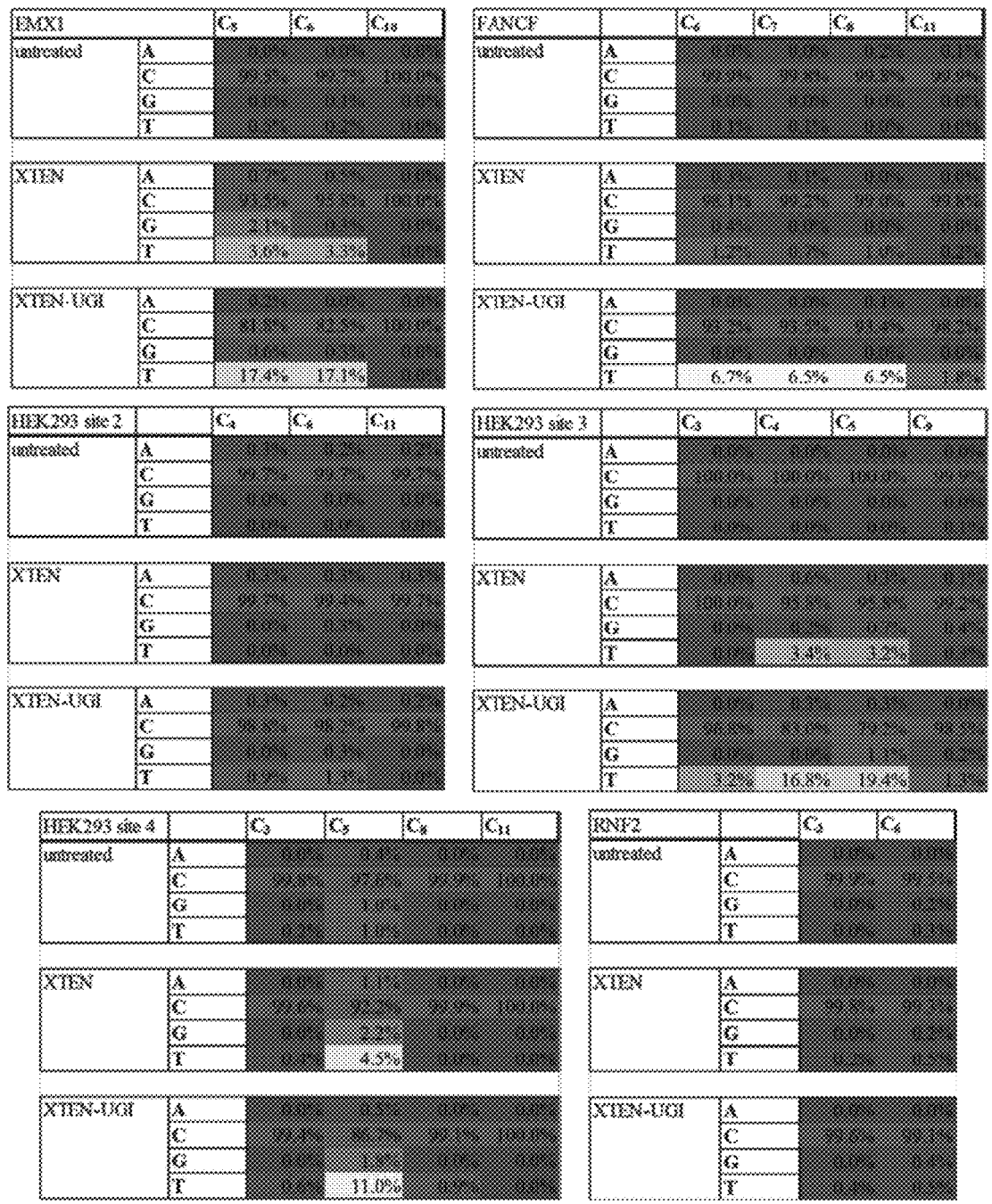
FIG. 10 shows C→T editing efficiencies in HEK293T cells is greatly enhanced by fusion with UGI.

FIG. 10 demonstrates that C→T editing efficiencies on the same protospacer sequences in HEK293T cells are greatly enhanced when a UGI domain is fused to the rAPOBEC1:dCas9 fusion protein.

(SEQ ID NO: 658)
rAPOBEC1-XTEN-dCas9-UGI-NLS primary sequence

MSSETFPVAVDPTLRRRIEPHEFEVFFDPRELRKETCLLYEINWGGRHSIWRHTSQNT

NKHVEVNFIEKFTTERYFCPNTRCSITWFLSWSPCGECSRAITEFLSRYPHVTLFIYIAR

LYHHADPRNRQGLRDLISSGVTIQIMTEQESGYCWRNFVNYSPNEAHWPRYPHLWV

RLYVLELYCIILGLPPCLNILRRKQPQLTFFTIALQSCHYQRLPPHILWATGLKSGSETP

GTSESATPESDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFFHRLEESFLV

EEDKKHERHPIFGNIVDEVAYHEKYPTIYHLRKKLVDSTDKADLRLIYLALAHMIKFR

GHFLIEGDLNPDNSDVDKLFIQLVQTYNQLFEENPINASGVDAKAILSARLSKSRRLE

NLIAQLPGEKKNGLFGNLIALSLGLTPNFKSNFDLAEDAKLQLSKDTYDDDLDNLLA

QIGDQYADLFLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEELLVKLNRED

LLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLL

YEYFTVYNELTKVKYVTEGMRKPAFLSGEQKKAIVDLLFKTNRKVTVKQLKEDYFK

-continued

KIECFDSVEISGVEDRFNASLGTYHDLLKIIKDKDFLDNEENEDILEDIVLTLTLFEDRE

MIEERLKTYAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVE

NTQLQNEKLYLYYLQNGRDMYVDQELDINRLSDYDVDAIVPQSFLKDDSIDNKVLT

RSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQ

RYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKV

LSMPQVNIVKKTEVQTGGFSKESILPKRNSDKLIARKKDWDPKKYGGFDSPTVAYSV

LVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIIHLFTLTNL

GAPAAFKYFDTTIDRKRYTSTKEVLDATLIHQSITGLYETRIDLSQLGGDSGGSTNLSD

IIEKETGKQLVIQESILMLPEEVEEVISNKPESDILVHTAYDESTDENVMLLTSDAP

EYKPWALVIQDSNGENKIKMLSGGS*PKKKRKV*

The percentages in FIGS. 9 and 10 are shown from sequencing both strands of the target sequence. Because only one of the strands is a substrate for deamination, the maximum possible deamination value in this assay is 50%. Accordingly, the deamination efficiency is double the percentages shown in the tables. E.g., a value of 50% relates to deamination of 100% of double-stranded target sequences. When a uracil glycosylase inhibitor (UGI) was fused to the dCas9:deaminase fusion protein (e.g., rAPOBEC1-XTEN-dCas9-[UGI]-NLS), a significant increase in editing efficiency in cells was observed. This result indicates that in mammalian cells, the DNA repair machinery that cuts out the uracil base in a U:G base pair is a rate-limiting process in DNA editing. Tethering UGI to the dVas9:deaminase fusion proteins greatly increases editing yields.

Without UGI, typical editing efficiencies in human cells were in the ~2-14% yield range (FIG. 9 and FIG. 10, "XTEN" entries). With UGI (FIG. 10, "UGI" entries) the editing was observed in the ~6-40% range. Using a UGI fusion is thus more efficient than the current alternative method of correcting point mutations via HDR, which also creates an excess of indels in addition to correcting the point mutation. No indels resulting from treatment with the cas9:deaminase:UGI fusions were observed.

Example 4

Direct, Programmable Conversion of a Target Nucleotide in Genomic DNA without Double-stranded DNA Cleavage Current genome-editing technologies introduce double-stranded DNA breaks at a target locus of interest as the first step to gene correction.[39,40] Although most genetic diseases arise from mutation of a single nucleobase to a different nucleobase, current approaches to revert such changes are very inefficient and typically induce an abundance of random insertions and deletions (indels) at the target locus as a consequence of the cellular response to double-stranded DNA breaks.[39,40] Reported herein is the development of nucleobase editing, a new strategy for genome editing that enables the direct conversion of one target nucleobase into another in a programmable manner, without requiring double-stranded DNA backbone cleavage. Fusions of CRISPR/Cas9 were engineered and the cytidine deaminase enzyme APOBEC1 that retain the ability to be programmed with a guide RNA, do not induce double-stranded DNA breaks, and mediate the direct conversion of cytidine to uracil, thereby effecting a C→T (or G→A) substitution following DNA replication, DNA repair, or transcription if the template strand is targeted. The resulting "nucleobase editors" convert cytidines within a window of approximately five nucleotides, and can efficiently correct a variety of point mutations relevant to human disease in vitro. In four transformed human and murine cell lines, second- and third-generation nucleobase editors that fuse uracil glycosylase inhibitor (UGI), and that use a Cas9 nickase targeting the non-edited strand, respectively, can overcome the cellular DNA repair response to nucleobase editing, resulting in permanent correction of up to 37% or (~15-75%) of total cellular DNA in human cells with minimal (typically ≤1%) indel formation. In contrast, canonical Cas9-mediated HDR on the same targets yielded an average of 0.7% correction with 4% indel formation. Nucleobase editors were used to revert two oncogenic p53 mutations into wild-type alleles in human breast cancer and lymphoma cells, and to convert an Alzheimer's Disease associated Arg codon in ApoE4 into a non-disease-associated Cys codon in mouse astrocytes. Base editing expands the scope and efficiency of genome editing of point mutations.

The clustered regularly interspaced short palindromic repeat (CRISPR) system is a prokaryotic adaptive immune system that has been adapted to mediate genome engineering in a variety of organisms and cell lines.[41] CRISPR/Cas9 protein-RNA complexes localize to a target DNA sequence through base pairing with a guide RNA, and natively create a DNA double-stranded break (DSB) at the locus specified by the guide RNA. In response to DSBs, endogenous DNA repair processes mostly result in random insertions or deletions (indels) at the site of DNA cleavage through non-homologous end joining (NHEJ). In the presence of a homologous DNA template, the DNA surrounding the cleavage site can be replaced through homology-directed repair (HDR). When simple disruption of a disease-associated gene is sufficient (for example, to treat some gain-of-function diseases), targeted DNA cleavage followed by indel formation can be effective. For most known genetic diseases, however, correction of a point mutation in the target locus, rather than stochastic disruption of the gene, is needed to address or study the underlying cause of the disease.[68]

Motivated by this need, researchers have invested intense effort to increase the efficiency of HDR and suppress NHEJ. For example, a small-molecule inhibitor of ligase IV, an essential enzyme in the NHEJ pathway, has been shown to increase HDR efficiency.[42,43] However, this strategy is challenging in post-mitotic cells, which typically down-regulate HDR, and its therapeutic relevance is limited by the potential risks of inhibiting ligase IV in non-target cells. Enhanced HDR efficiency can also be achieved by the timed delivery of Cas9-guide RNA complexes into chemically synchronized cells, as HDR efficiency is highly cell-cycle dependent.[44] Such an approach, however, is limited to research applications in cell culture since synchronizing cells is highly disruptive. Despite these developments, current strategies to replace point mutations using HDR in most contexts are very inefficient (typically ~0.1 to 5%),[42,43,45,46,75] especially in unmodified, non-dividing cells. In addition, HDR competes with NHEJ during the resolution of double-stranded breaks, and indels are generally more abundant outcomes than gene replacement. These observations highlight the need to develop alternative approaches to install specific modifications in genomic DNA that do not rely on creating double-stranded DNA breaks. A small-molecule inhibitor of ligase IV, an essential enzyme in the NHEJ pathway, has been shown to increase HDR efficiency.[42,43] However, this strategy is challenging in post-mitotic cells, which typically down-regulate HDR, and its therapeutic relevance is limited by the potential risks of inhibiting ligase IV in non-target cells. Enhanced HDR efficiency can also be achieved by the timed delivery of Cas9-guide RNA complexes into chemically synchronized cells, as HDR efficiency is highly cell-cycle dependent.[44] Such an approach, however, is limited to research applications in cell culture since synchronizing cells is highly disruptive. In some cases, it is possible to design HDR templates such that the product of successful HDR contains mutations in the PAM sequence and therefore is no longer a substrate for subsequent Cas9 modification, increasing the overall yield of HDR products,[75] although such an approach imposes constraints on the product sequences. Recently, this strategy has been coupled to the use of ssDNA donors that are complementary to the non-target strand and high-efficiency ribonucleoprotein (RNP) delivery to substantially increase the efficiency of HDR, but even in these cases the ratio of HDR to NHEJ outcomes is relatively low (<2).[83]

Figure 11A:
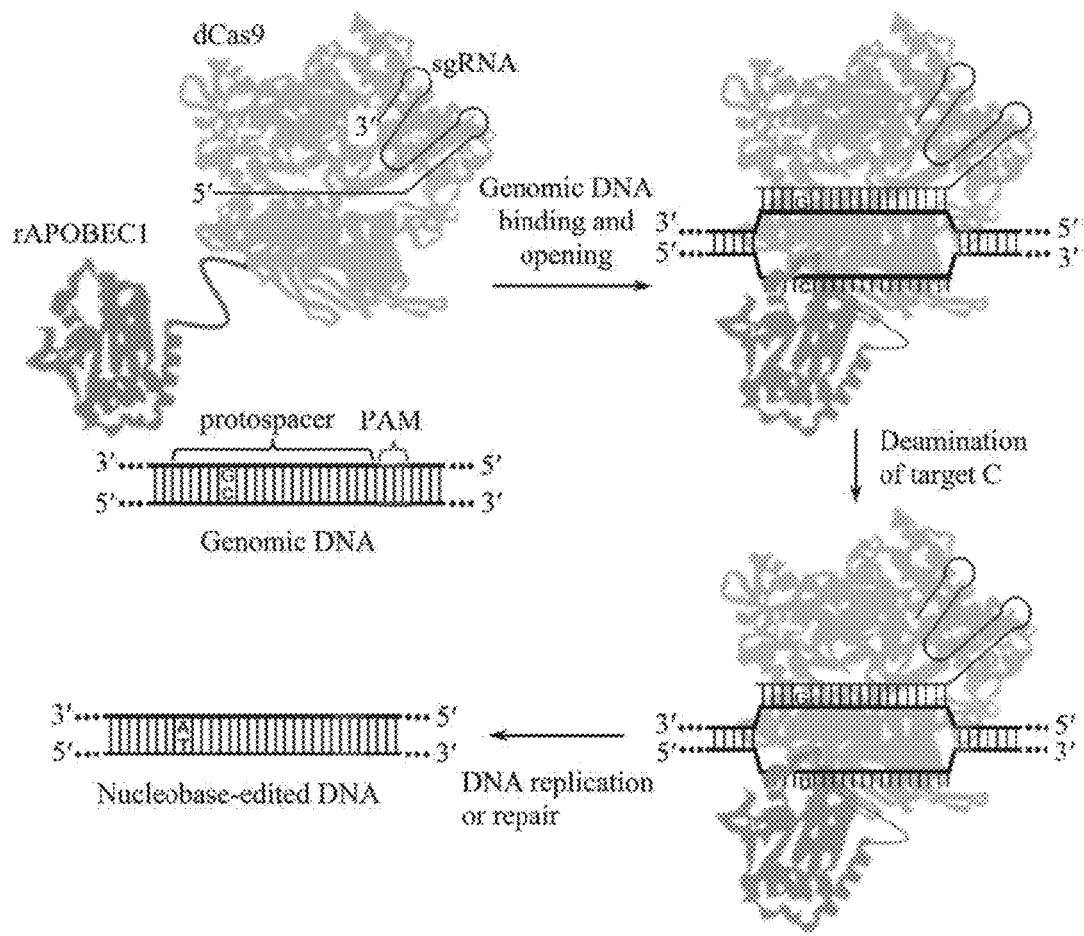
FIGS. 11A to 11C show NBE1 mediates specific, guide RNA-programmed C to U conversion in vitro.

It was envisioned that direct catalysis of the conversion of one nucleobase to another at a programmable target locus without requiring DNA backbone cleavage could increase the efficiency of gene correction relative to HDR without introducing undesired random indels at the locus of interest. Catalytically dead Cas9 (dCas9), which contains Asp10Ala and His840Ala mutations that inactivate its nuclease activity, retains its ability to bind DNA in a guide RNA-programmed manner but does not cleave the DNA backbone.[16,47] In principle, conjugation of dCas9 with an enzymatic or chemical catalyst that mediates the direct conversion of one nucleobase to another could enable RNA-programmed nucleobase editing. The deamination of cytosine (C) is catalyzed by cytidine deaminases[29] and results in uracil (U), which has the base pairing properties of thymine (T). dCas9 was fused to cytidine deaminase enzymes in order to test their ability to convert C to U at a guide RNA-specified DNA locus. Most known cytidine deaminases operate on RNA, and the few examples that are known to accept DNA require single-stranded DNA.[48] Recent studies on the dCas9-target DNA complex reveal that at least nine nucleotides of the displaced DNA strand are unpaired upon formation of the Cas9:guide RNA:DNA "R-loop" complex.[12] Indeed, in the structure of the Cas9 R-loop complex the first 11 nucleotides of the protospacer on the displaced DNA strand are disordered, suggesting that their movement is not highly restricted.[76] It has also been speculated that Cas9 nickase-induced mutations at cytosines in the non-template strand might arise from their accessibility by cellular cytidine deaminase enzymes.[77] Recent studies on the dCas9-target DNA complex have revealed that at least 26 bases on the non-template strand are unpaired when Cas9 binds to its target DNA sequence.[49] It was reasoned that a subset of this stretch of single-stranded DNA in the R-loop might serve as a substrate for a dCas9-tethered cytidine deaminase to effect direct, programmable conversion of C to U in DNA (FIG. 11A).

Figure 11B:
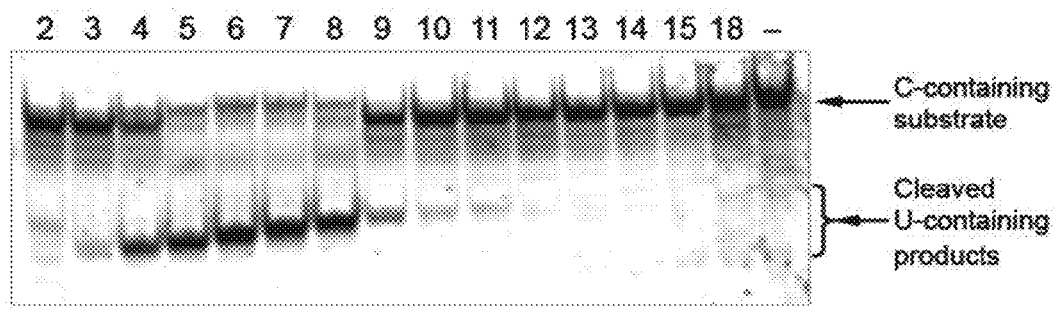
Figure 11C:
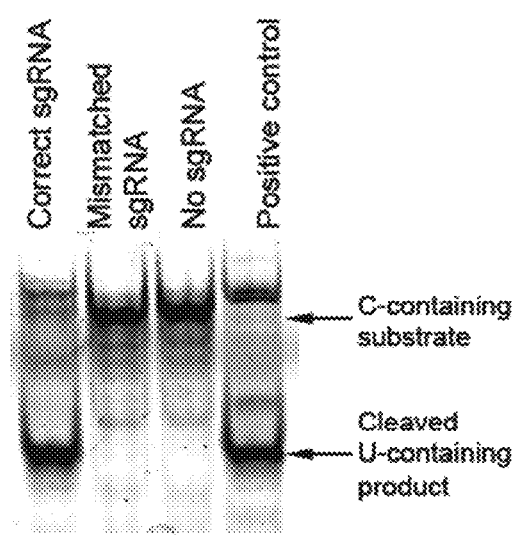
Figure 36A:
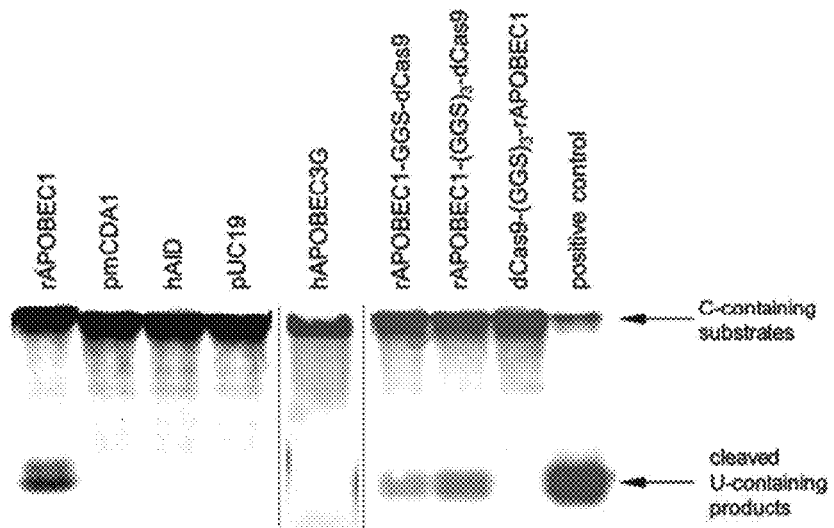
Figure 36B:
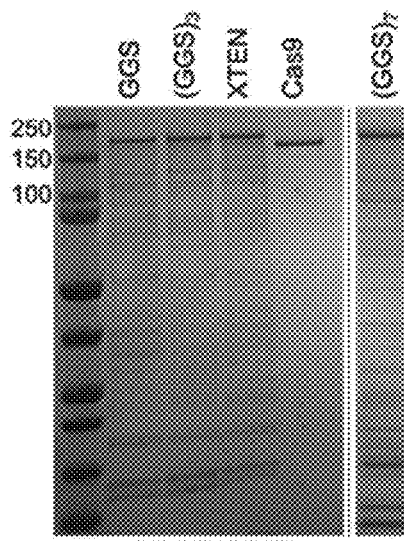
Figure 36C:
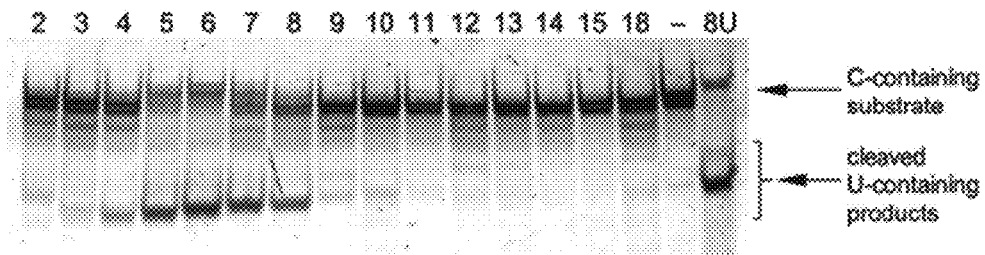

Four different cytidine deaminase enzymes (hAID, hAPOBEC3G, rAPOBEC1, and pmCDA1) were expressed in a mammalian cell lysate-derived in vitro transcription-translation system and evaluated for ssDNA deamination. Of the four enzymes, rAPOBEC1 showed the highest deaminase activity under the tested conditions and was chosen for dCas9 fusion experiments (FIG. 36A). Although appending rAPOBEC1 to the C-terminus of dCas9 abolishes deaminase activity, fusion to the N-terminus of dCas9 preserves deaminase activity on ssDNA at a level comparable to that of the unfused enzyme. Four rAPOBEC1-dCas9 fusions were expressed and purified with linkers of different length and composition (FIG. 36B), and evaluated each fusion for single guide RNA (sgRNA)-programmed dsDNA deamination in vitro (FIGS. 11A to 11C and FIGS. 15A to 15D). Efficient, sequence-specific, sgRNA-dependent C to U conversion was observed in vitro (FIGS. 11A to 11C). Conversion efficiency was greatest using rAPOBEC1-dCas9 linkers over nine amino acids in length. The number of positions susceptible to deamination (the deamination "activity window") increases with linker length was extended from three to 21 amino acids (FIGS. 36C to 36F 15A to 15D). The 16-residue XTEN linker[50] was found to offer a promising balance between these two characteristics, with an efficient deamination window of approximately five nucleotides, from positions 4 to 8 within the protospacer, counting the end distal to the protospacer-adjacent motif (PAM) as position 1. The rAPOBEC1-XTEN-dCas9 protein served as the first-generation nucleobase editor (NBE1).

Figure 12A:
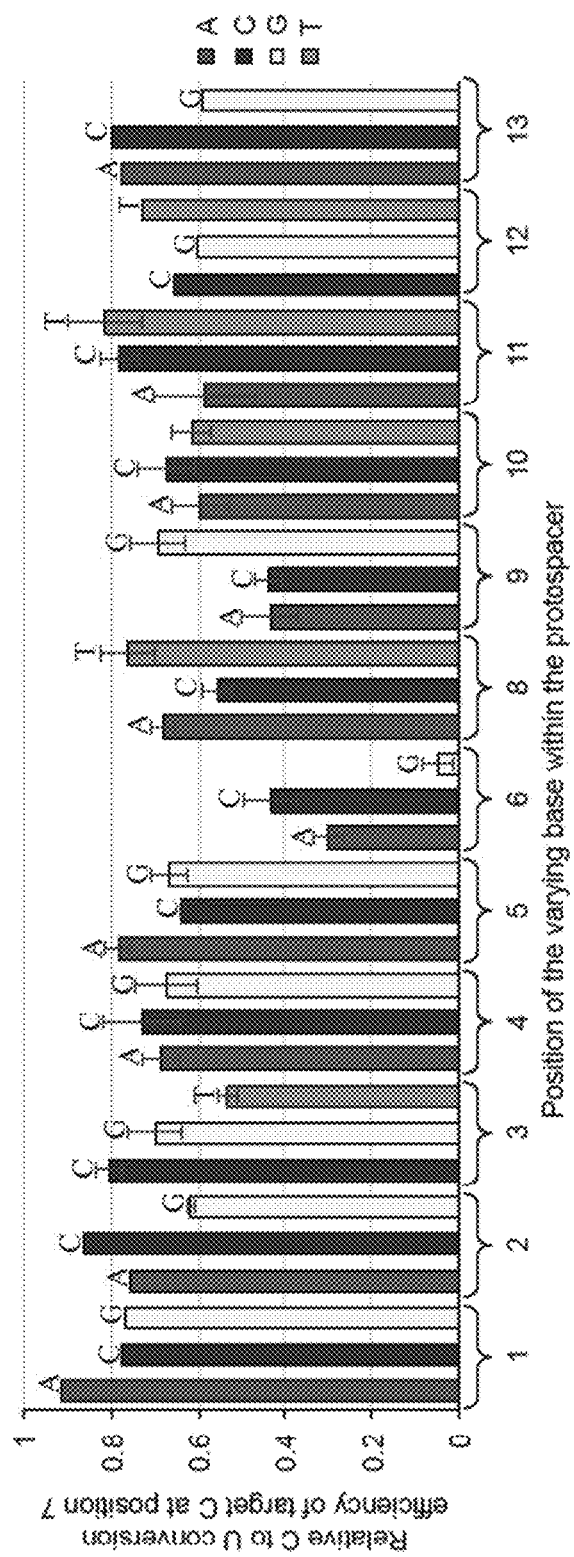
FIGS. 12A to 12B show effects of sequence context and target C position on nucleobase editing efficiency in vitro.
Figures 12B, 13A:
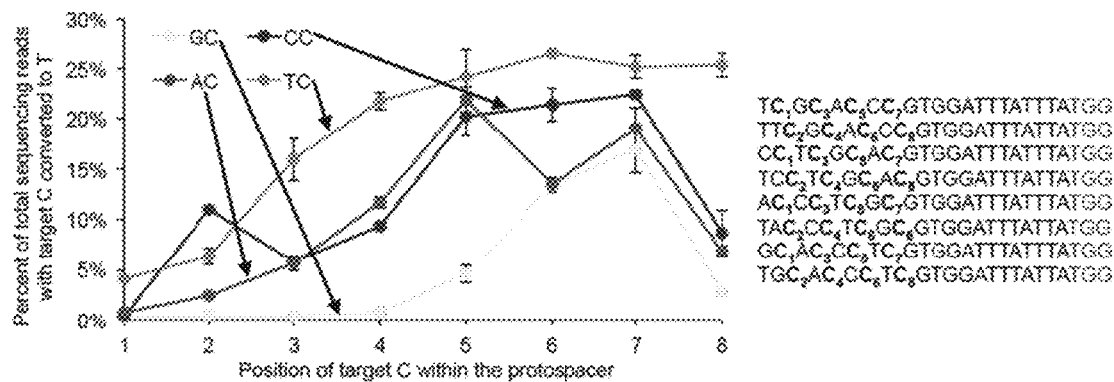
FIGS. 13A to 13C show nucleobase editing in human cells.

Elected were seven mutations relevant to human disease that in theory could be corrected by C to T nucleobase editing, synthesized double-stranded DNA 80-mers of the corresponding sequences, and assessed the ability of NBE1 to correct these mutations in vitro (FIGS. 16A to 16B). NBE1 yielded products consistent with efficient editing of the target C, or of at least one C within the activity window when multiple Cs were present, in six of these seven targets in vitro, with an average apparent editing efficiency of 44% (FIGS. 16A to 16B). In the three cases in which multiple Cs were present within the deamination window, evidence of deamination of some or all of these cytosines was observed. In only one of the seven cases tested were substantial yields of edited product observed (FIGS. 16A to 16 B). Although the preferred sequence context for APOBEC1 substrates is reported to be CC or TC,[51] it was anticipated that the increased effective molarity of the deaminase and its single-stranded DNA substrate mediated by dCas9 binding to the target locus may relax this restriction. To illuminate the sequence context generality of NBE1, its ability to edit a 60-mer double-stranded DNA oligonucleotide containing a single fixed C at position 7 within the protospacer was assayed, as well as all 36 singly mutated variants in which protospacer bases 1-6 and 8-13 were individually varied to each of the other three bases. Each of these 37 sequences were treated with 1.9 µM NBE1, 1.9 µM of the corresponding sgRNA, and 125 nM DNA for 2 h, similar to standard conditions for in vitro Cas9 assays[52]. High-throughput DNA sequencing (HTS) revealed 50 to 80% C to U conversion of targeted strands (25 to 40% of total sequence reads arising from both DNA strands, one of which is not a substrate for NBE1) (FIG. 12A). The nucleotides surrounding the target C had little effect on editing efficiency was independent of sequence context unless the base immediately 5' of the target C is a G, in which case editing efficiency was substantially lower (FIGS. 12A to 12B). NBE1 activity in vitro was assessed on all four NC motifs at positions 1 through 8 within the protospacer (FIGS. 12A to 12B). In general NBE1 activity on substrates was observed to follow the order TC≥CC≥AC≥GC, with maximum editing efficiency achieved when the target C is at or near position 7. In addition, it was observed that the nucleobase editor is highly processive, and will efficiently convert most of all Cs to Us on the same DNA strand within the 5-base activity window (FIG. 17).

Figures 28, 29A:
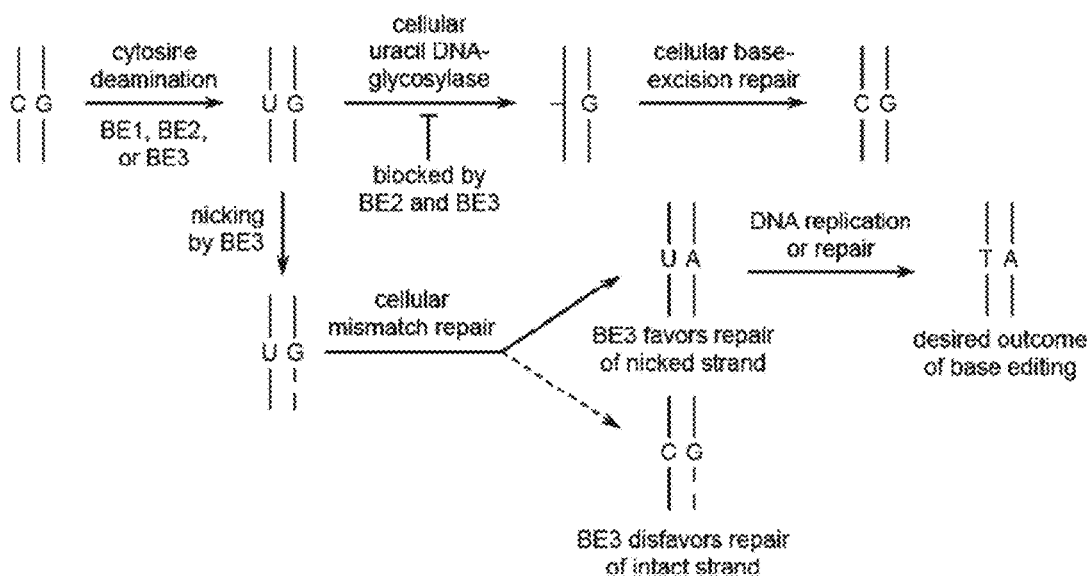
FIG. 28 shows non-target C mutation rates. Shown here are the C to T mutation rates at 2,500 distinct cytosines surrounding the six on-target and 34 off-target loci tested, representing a total of 14,700,000 sequence reads derived from approximately 1.8×106 cells.
FIGS. 29A to 29C show base editing in human cells.

While BE1 efficiently processes substrates in a test tube, in cells a tree of possible DNA repair outcomes determines the fate of the initial U:G product of base editing (FIG. 29A). To test the effectiveness of nucleobase editing in human cells, NBE1 codon usage was optimized for mammalian expression, appended a C-terminal nuclear localization sequence (NLS),[53] and assayed its ability to convert C to T in human cells on 14Cs in six well-studied target sites throughout the human genome (FIG. 37A).[54] The editable Cs were confirmed within each protospacer in vitro by incubating NBE1 with synthetic 80-mers that correspond to the six different genomic sites, followed by HTS (FIGS. 13A to 13C, FIG. 29B and FIG. 25). Next, HEK293T cells were transfected with plasmids encoding NBE1 and one of the six target sgRNAs, allowed three days for nucleobase editing to occur, extracted genomic DNA from the cells, and analyzed the loci by HTS. Although C to T editing in cells at the target locus was observed for all six cases, the efficiency of nucleobase editing was 1.1% to 6.3% or 0.8%-7.7% of total DNA sequences (corresponding to 2.2% to 12.6% of targeted strands), a 6.3-fold to 37-fold or 5-fold to 36-fold decrease in efficiency compared to that of in vitro nucleobase editing (FIGS. 13A to 13C, FIG. 29B and FIG. 25). It was observed that some base editing outside of the typical window of positions 4 to 8 when the substrate C is preceded by a T, which we attribute to the unusually high activity of APOBEC1 for TC substrates.[48]

It was asked whether the cellular DNA repair response to the presence of U:G heteroduplex DNA was responsible for the large decrease in nucleobase editing efficiency in cells (FIG. 29A). Uracil DNA glycosylase (UDG) catalyzes removal of U from DNA in cells and initiates base excision repair (BER), with reversion of the U:G pair to a C:G pair as the most common outcome (FIG. 29A).[55] Uracil DNA glycosylase inhibitor (UGI), an 83-residue protein from *B. subtilis* bacteriophage PBS1, potently blocks human UDG activity ($IC_{50}$=12 pM).[56] UGI was fused to the C-terminus of NBE1 to create the second-generation nucleobase editor NBE2 and repeated editing assays on all six genomic loci. Editing efficiencies in human cells were on average 3-fold higher with NBE2 than with NBE1, resulting in gene conversion efficiencies of up to 22.8% of total DNA sequenced (up to 45.6% of targeted strands) (FIGS. 13A to 13C and FIG. 29B). To test base editing in human cells, BE1 codon usage was optimized for mammalian expression and appended a C-terminal nuclear localization sequence (NLS).[53]

Figure 19:
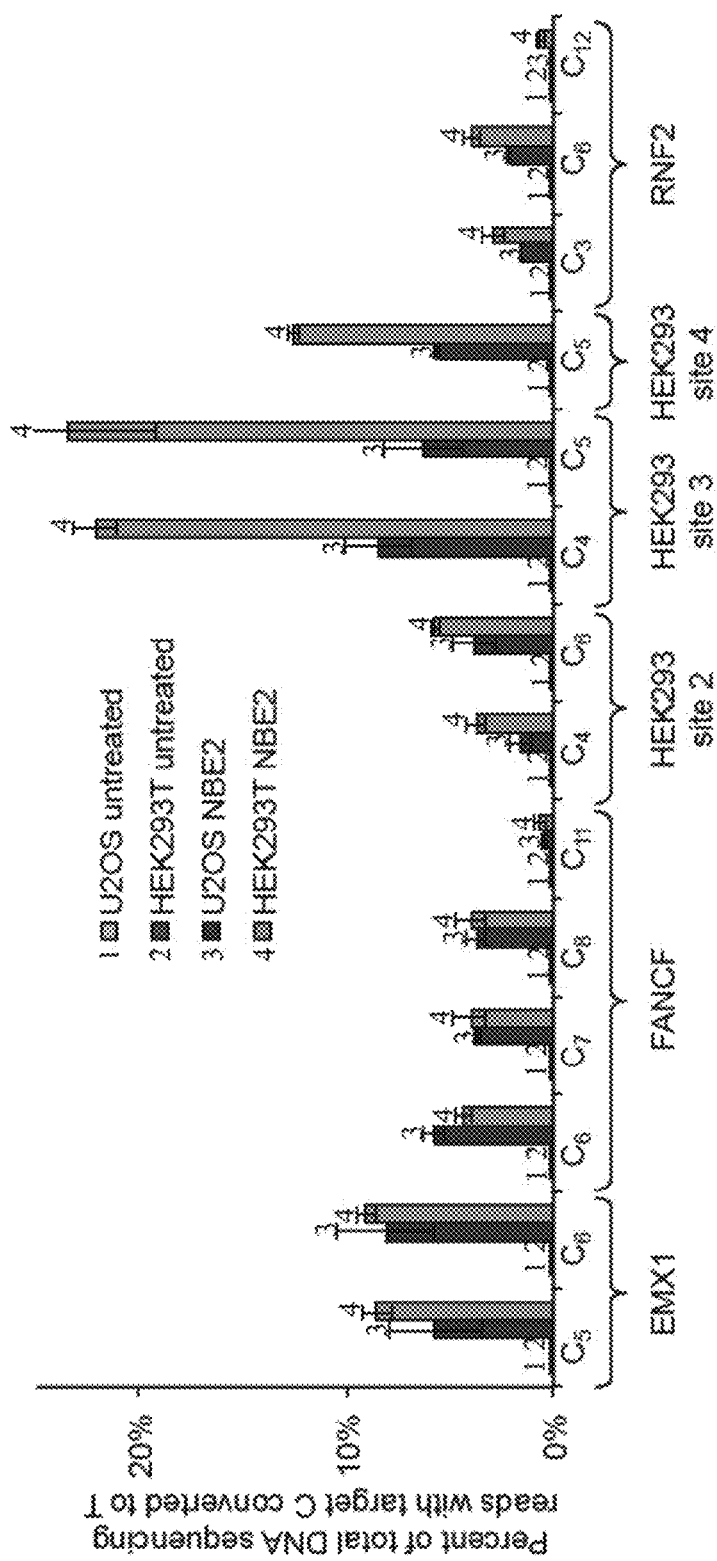
FIG. 19 shows nucleobase editing efficiencies of NBE2 in U2OS and HEK293T cells. Cellular C to T conversion percentages by NBE2 are shown for each of the six targeted genomic loci in HEK293T cells and U2OS cells. HEK293T cells were transfected using lipofectamine 2000, and U2OS cells were nucleofected. U2OS nucleofection efficiency was 74%. Three days after plasmid delivery, genomic DNA was extracted and analyzed for nucleobase editing at the six genomic loci by FITS. Values and error bars reflect the mean and standard deviation of at least two biological experiments done on different days.

Similar editing efficiencies were observed when a separate plasmid overexpressing UGI was co-transfected with NBE1 (FIGS. 18A to 18H). However, while the direct fusion of UGI to NBE1 resulted in no significant increase in C to T mutations at monitored non-targeted genomic locations, overexpression of unfused UGI detectably increased the frequency of C to T mutations elsewhere in the genome (FIGS. 18A to 18H). The generality of NBE2-mediated nucleobase editing was confirmed by assessing editing efficiencies on the same six genomic targets in U2OS cells, and observed similar results with those in HEK293T cells (FIG. 19). Importantly, NBE2 typically did not result in any detectable indels (FIG. 13C and FIG. 29C), consistent with the known mechanistic dependence of NHEJ on double-stranded DNA breaks.[57,78] Together, these results indicate that conjugating UGI to NBE1 can greatly increase the efficiency of nucleobase editing in human cells.

Figure 20:
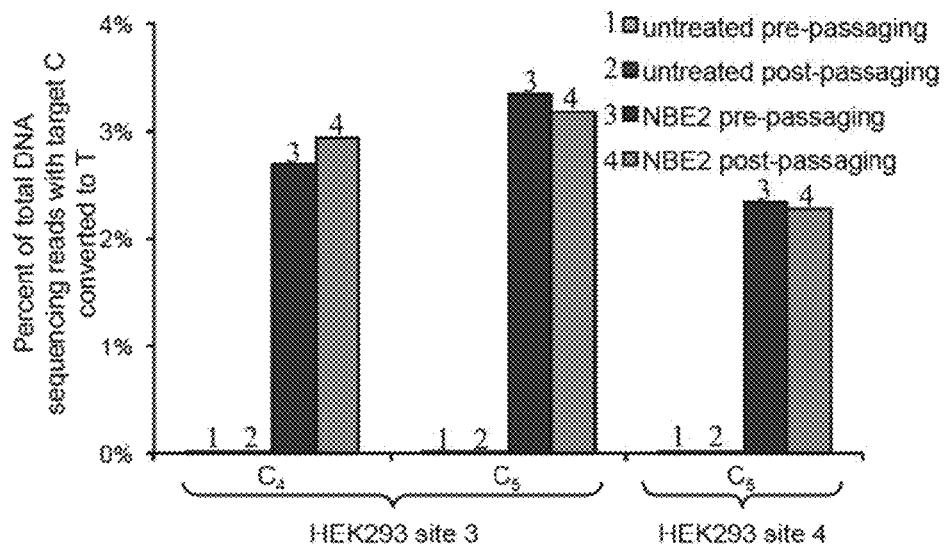
FIG. 20 shows nucleobase editing persists over multiple cell divisions. Cellular C to T conversion percentages by NBE2 are displayed at two genomic loci in HEK293T cells before and after passaging the cells. HEK293T cells were transfected using Lipofectamine 2000. Three days post transfection, the cells were harvested and split in half. One half was subjected to HTS analysis, and the other half was allowed to propagate for approximately five cell divisions, then harvested and subjected to HTS analysis.

The permanence of nucleobase editing in human cells was confirmed by monitoring editing efficiencies over multiple cell divisions in HEK293T cells at two of the tested genomic loci. Genomic DNA was harvested at two time points: three days after transfection with plasmids expressing NBE2 and appropriate sgRNAs, and after passaging the cells and growing them for four additional days (approximately five subsequent cell divisions). No significant change in editing efficiency was observed between the non-passaged cells (editing observed in 4.6% to 6.6% of targeted strands for three different target Cs) and passaged cells (editing observed in 4.6% to 6.4% of targeted strands for the same three target Cs), confirming that the nucleobase edits became permanent following cell division (FIG. 20). Indels will on rare occasion arise from the processing of U:G lesions by cellular repair processes, which involve single-strand break intermediates that are known to lead to indels.[84] Given that several hundred endogenous U:G lesions are generated every day per human cell from spontaneous cytidine deaminase,[85] it was anticipate that the total indel frequency from U:G lesion repair is unlikely to increase from BE1 or BE2 activity at a single target locus.

Figure 13B:
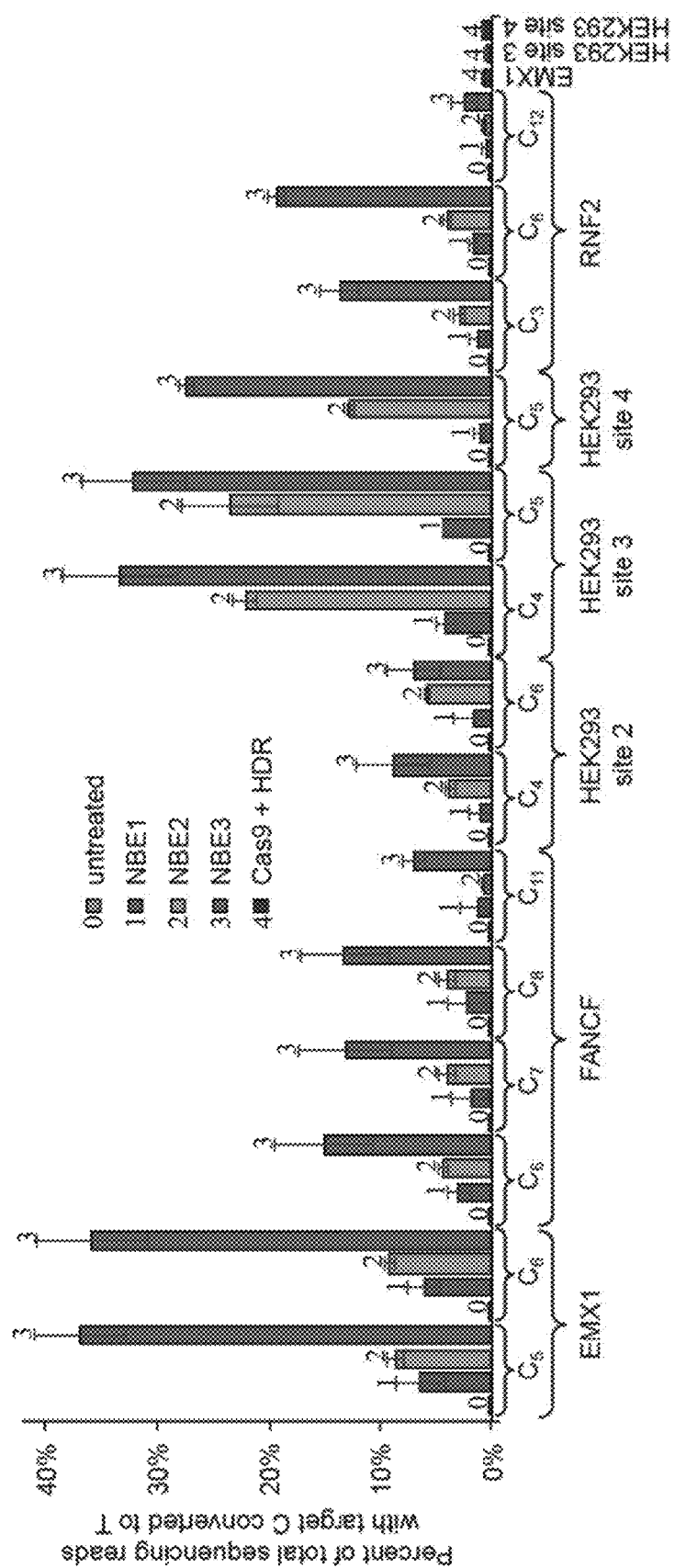
Figure 13C:
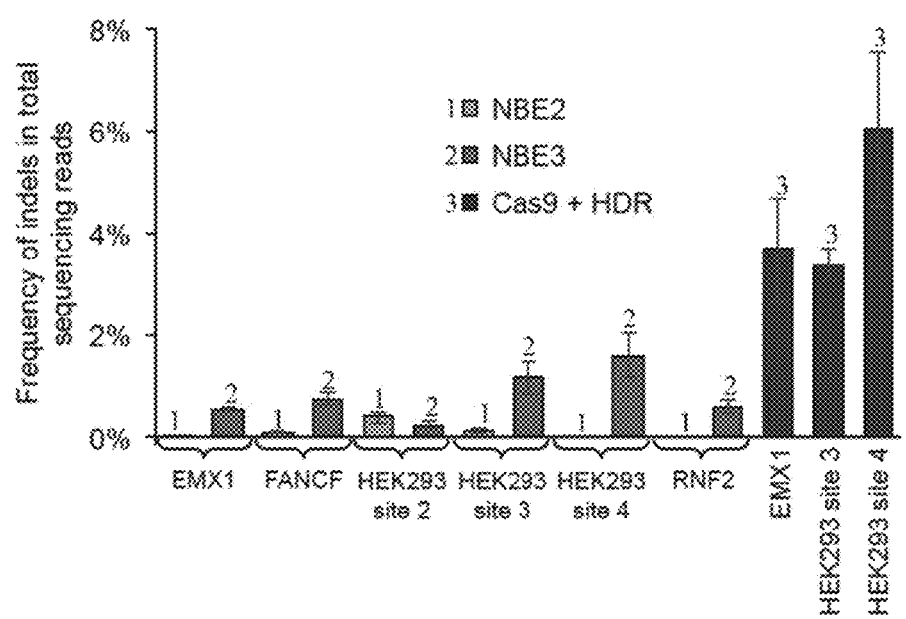
Figure 15A:
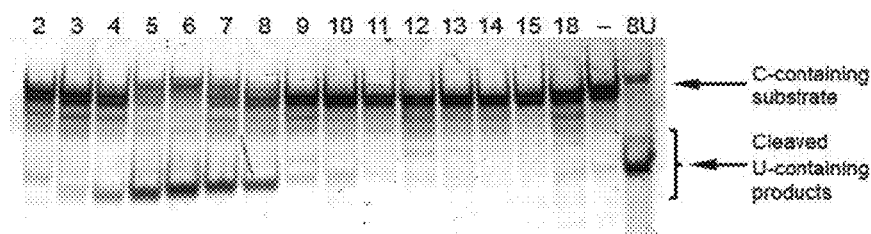
FIGS. 15A to 15D show effects of deaminase-dCas9 linker length and composition on nucleobase editing. Gel-based deaminase assay showing the deamination window of nucleobase editors with deaminase-Cas9 linkers of GGS (FIG. 15A), $(GGS)_3$ (SEQ ID NO: 596) (FIG. 15B), XTEN (FIG. 15C), or $(GGS)_7$ (SEQ ID NO: 597) (FIG. 15D). Following incubation of 1.85 µM editor-sgRNA complexes with 125 nM dsDNA substrates at 37° C. for 2 h, the dye-conjugated DNA was isolated and incubated with USER enzyme (uracil DNA glycosylase and endonuclease VIII) at 37° C. for an additional hour to cleave the DNA backbone at the site of any uracils. The resulting DNA was resolved on a denaturing polyacrylamide gel, and the dye-conjugated strand was imaged. Each lane is numbered according to the position of the target C within the protospacer, or with—if no target C is present. 8U is a positive control sequence with a U synthetically incorporated at position 8.
Figure 15B:
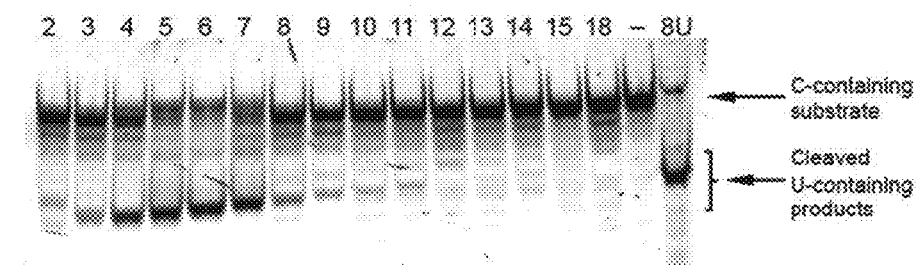
Figure 15C:
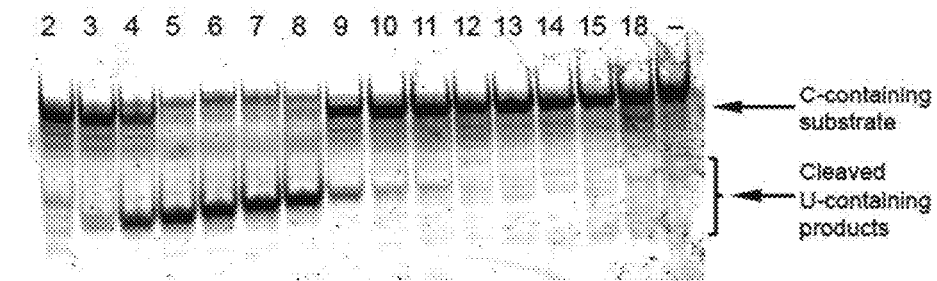
Figure 15D:
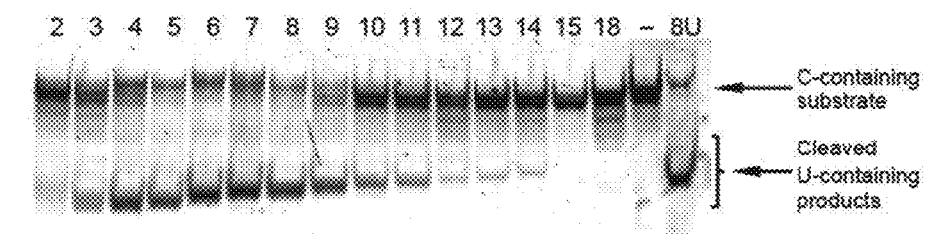
Figure 29B:
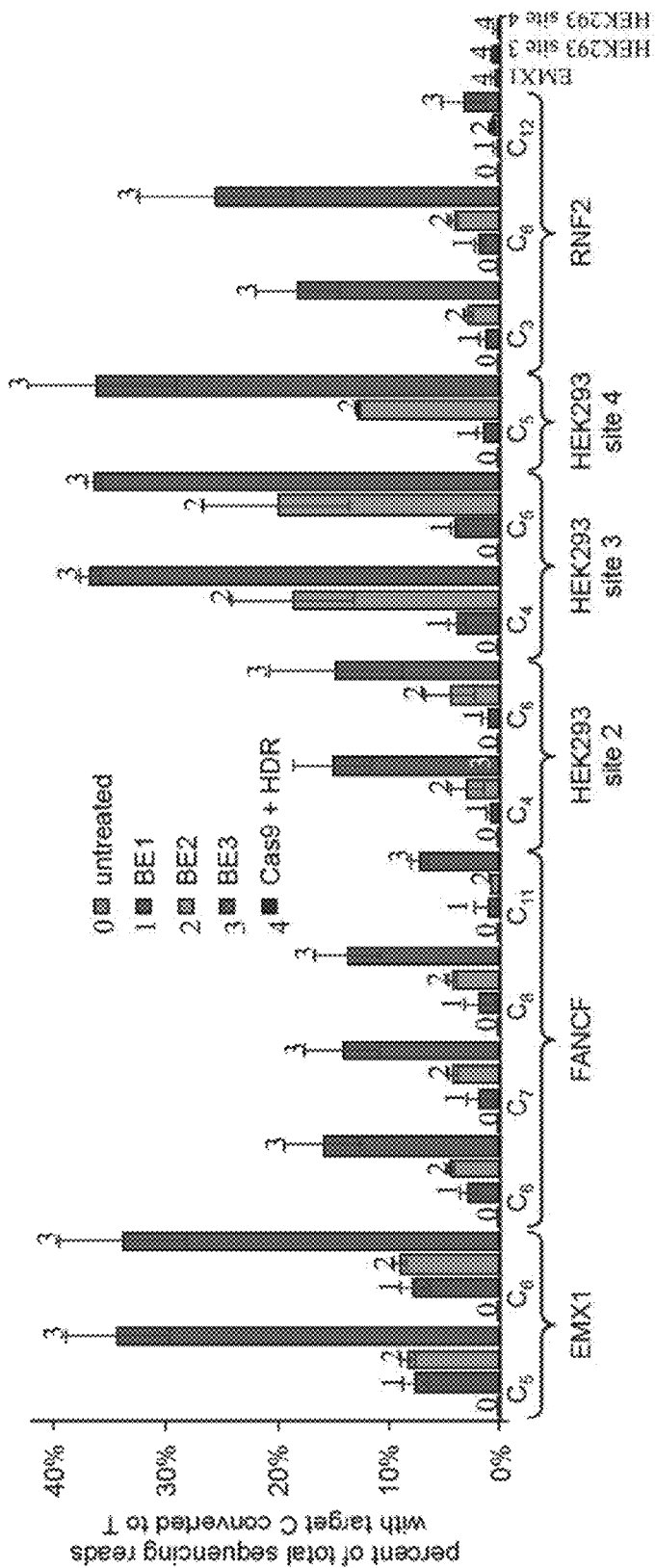
Figure 29C:
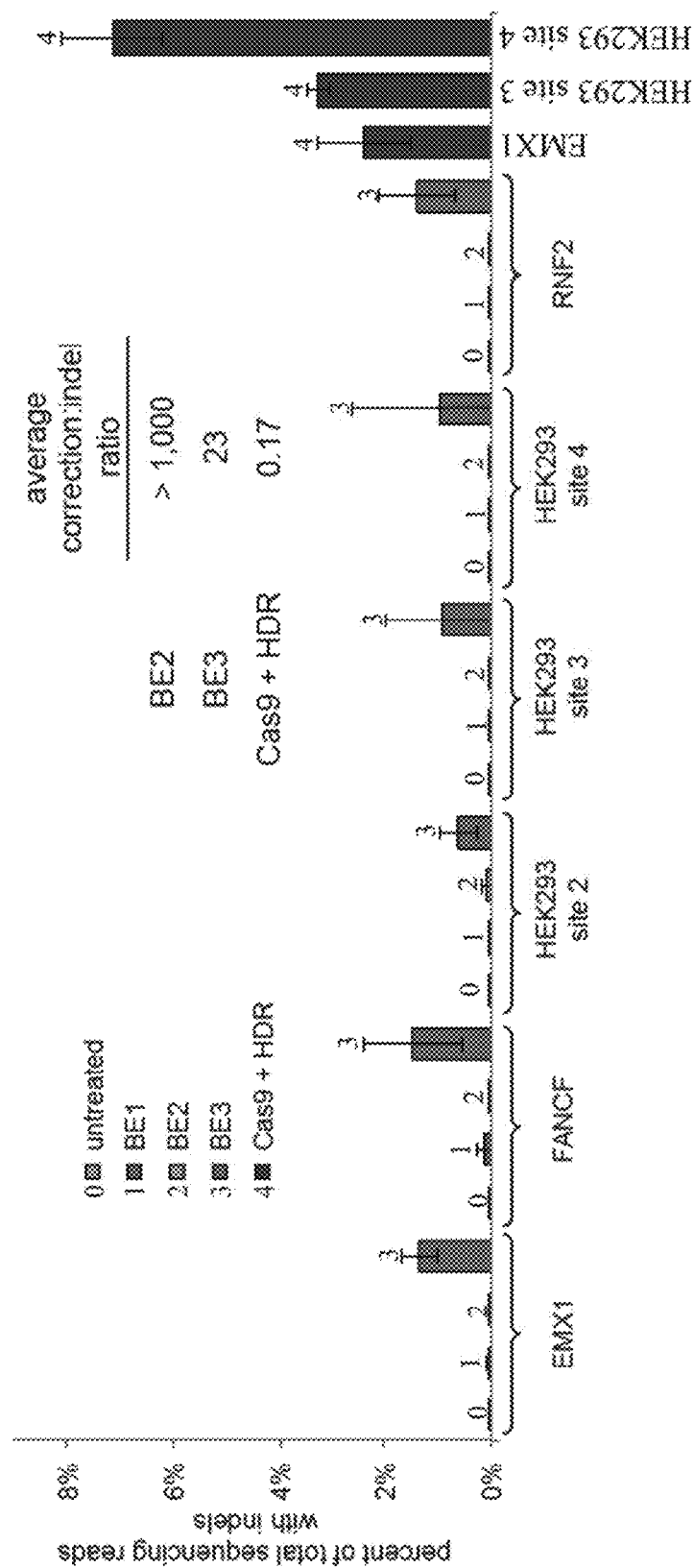
Figure 34:
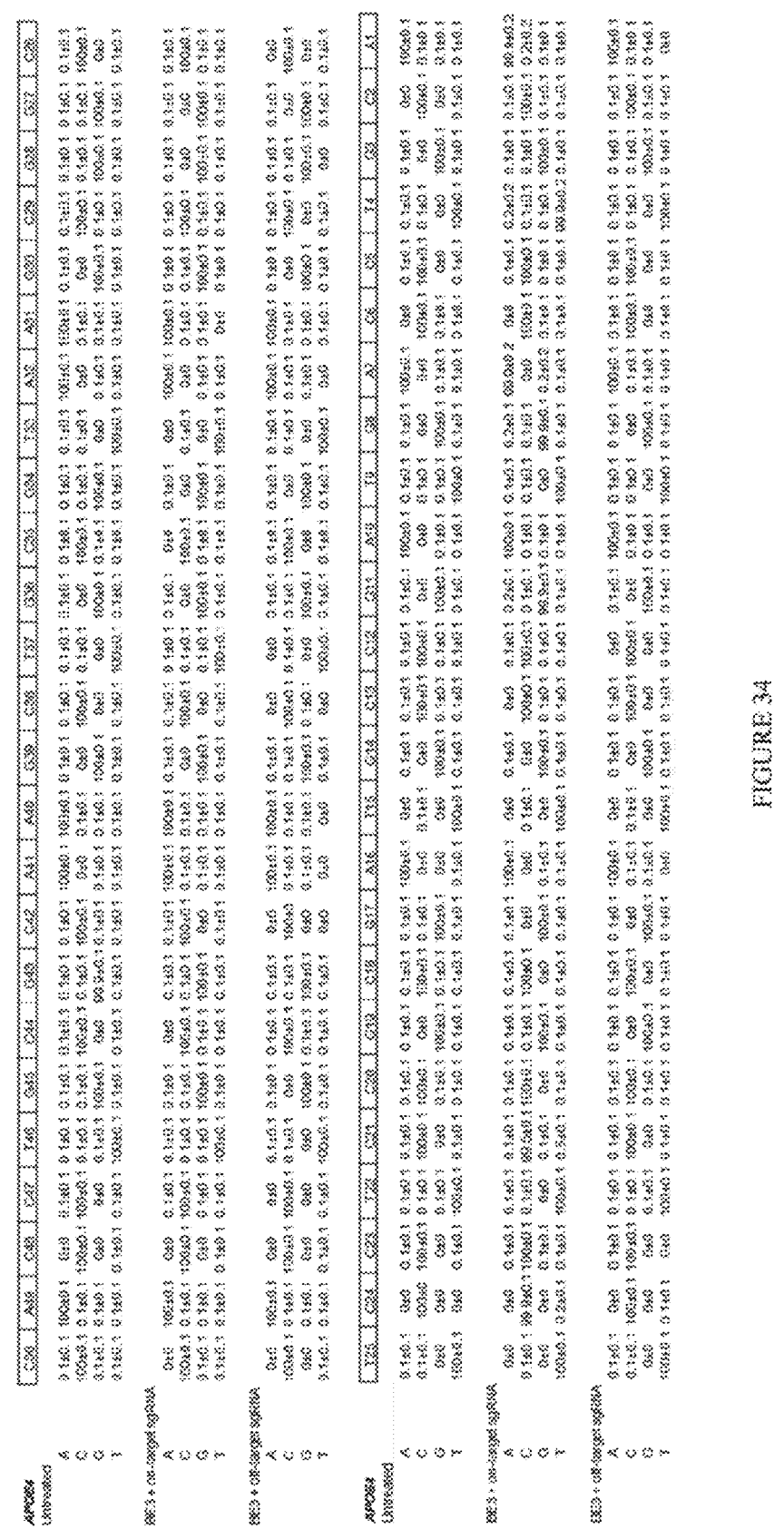
Figure 34:
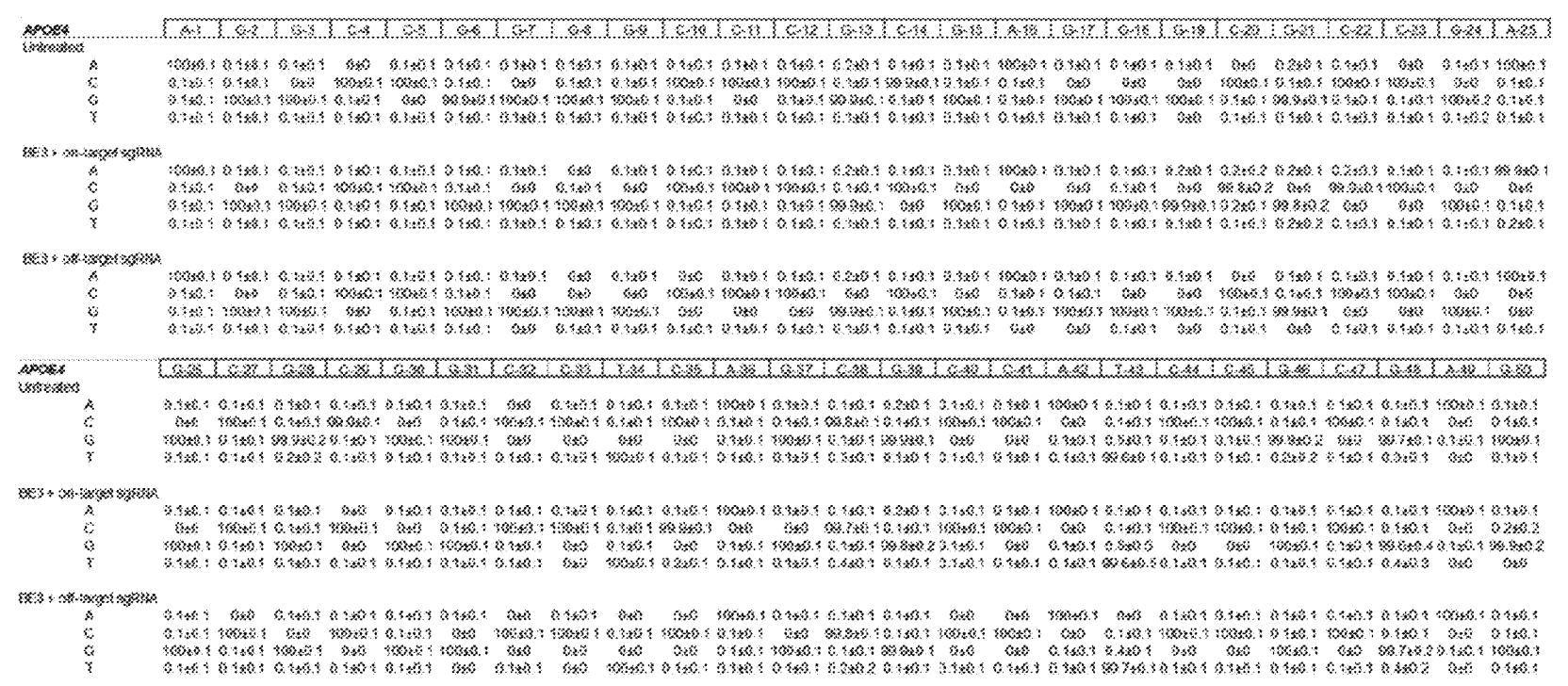

To further increase the efficiency of nucleobase editing in cells, it was anticipated that nicking the non-edited strand may result in a smaller fraction of edited Us being removed by the cell, since eukaryotic mismatch repair machinery uses strand discontinuity to direct DNA repair to any broken strand of a mismatched duplex (FIG. 29A).[58,79,80] The catalytic His residue was restored at position 840 in the Cas9 HNH domain,[47,59] resulting in the third-generation nucleobase editor NBE3 that nicks the non-edited strand containing a G opposite the targeted C, but does not cleave the target strand containing the C. Because NBE3 still contains the Asp10Ala mutation in Cas9, it does not induce double-stranded DNA cleavage. This strategy of nicking the non-edited strand augmented nucleobase editing efficiency in human cells by an additional 1.4- to 4.8-fold relative to NBE2, resulting in up to 36.3% of total DNA sequences containing the targeted C to T conversion on the same six human genomic targets in HEK293T cells (FIGS. 13A to 13C and FIG. 29B). Importantly, only a small frequency of indels, averaging 0.8% (ranging from 0.2% to 1.6% for the six different loci), was observed from NBE3 treatment (FIG. 13C, FIG. 29C, and FIG. 34). In contrast, when cells were treated with wild-type Cas9, sgRNA, and a single-stranded DNA donor template to mediate HDR at three of these loci C to T conversion efficiencies averaging only 0.7% were observed, with much higher relative indel formation averaging 3.9% (FIGS. 13A to 13C and FIG. 29C). The ratio of allele conversion to NHEJ outcomes averaged >1,000 for BE2, 23 for BE3, and 0.17 for wild-type Cas9 (FIG. 3c). We confirmed the permanence of base editing in human cells by monitoring editing efficiencies over multiple cell divisions in HEK293T cells at the HEK293 site 3 and 4 genomic loci (FIG. 38). These results collectively establish that nucleobase editing can effect much more efficient targeted single-base editing in human cells than Cas9-mediated HDR, and with much less (NBE3) or no (NBE2) indel formation.

Next, the off-target activity of NBE1, NBE2, and NBE3 in human cells was evaluated. The off-target activities of Cas9, dCas9, and Cas9 nickase have been extensively studied (FIGS. 23 to 24 and 31 to 33).[54,60-62] Because the sequence preference of rAPOBEC1 has been shown to be independent of DNA bases more than one base from the target C,[63] consistent with the sequence context independence observed in FIGS. 12A to 12B, it was assumed that potential off-target activity of nucleobase editors arises from off-target Cas9 binding. Since only a fraction of Cas9 off-target sites will have a C within the active window for nucleobase editing, off-target nucleobase editing sites should be a subset of the off-target sites of canonical Cas9 variants. For each of the six sites studied, the top ten known Cas9 off-target loci in human cells that were previously determined using the GUIDE-seq method were sequenced (FIGS. 23 to 27 and 31 to 33).[54, 61] Detectable off-target nucleobase editing at only a subset (16/34, 47% for NBE1 and NBE2, and 17/34, 50% for NBE3) of known dCas9 off-target loci was observed. In all cases, the off-target base-editing substrates contained a C within the five-base target window. In general, off-target C to T conversion paralleled off-target Cas9 nuclease-mediated genome modification frequencies (FIGS. 23 to 27). Also monitored were C to T conversions at 2,500 distinct cytosines surrounding the six on-target and 34 off-target loci tested, representing a total of 14,700,000 sequence reads derived from approximately $1.8 \times 10^6$ cells, and observed no detectable increase in C to T conversions at any of these other sites upon NBE1, NBE2, or NBE3 treatment compared to that of untreated cells (FIG. 28). Taken together, these findings suggest that off-target substrates of nucleobase editors include a subset of Cas9 off-target substrates, and that nucleobase editors in human cells do not induce untargeted C to T conversion throughout the genome at levels that can be detected by the methods used here. No substantial change was observed in editing efficiency between non-passaged HEK293T cells (editing observed in 1.8% to 2.6% of sequenced strands for the three target Cs with BE2, and 6.2% to 14.3% with BE3) and cells that had undergone approximately five cell divisions after base editing (editing observed in 1.9% to 2.3% of sequenced strands for the same target Cs with BE2, and 6.4% to 14.5% with BE3), confirming that base edits in these cells are durable (FIG. 38).

Figure 30A:
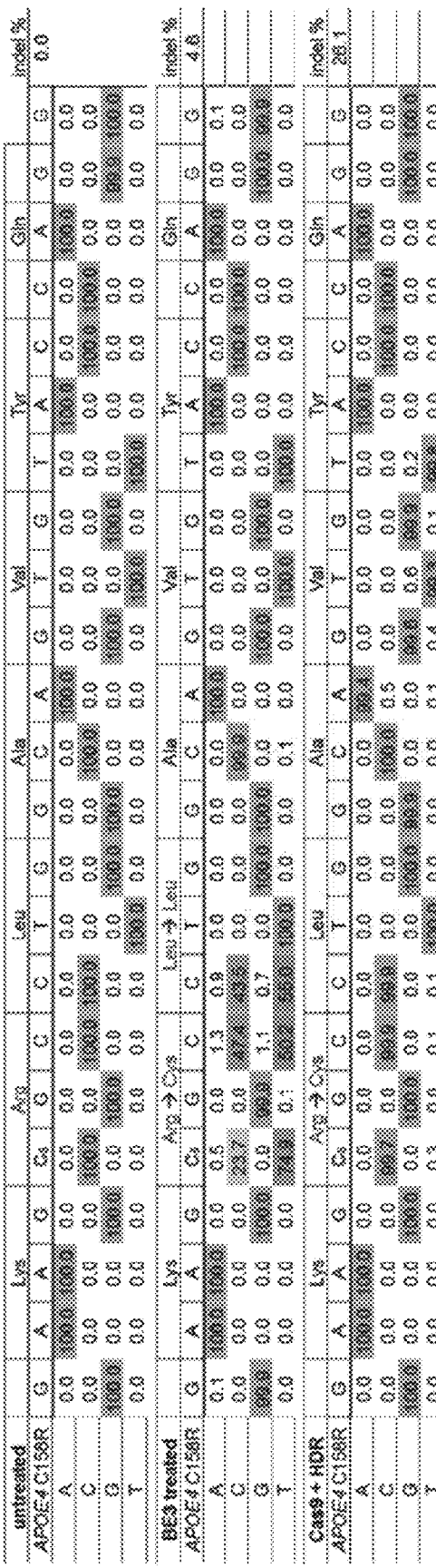
Figure 35:
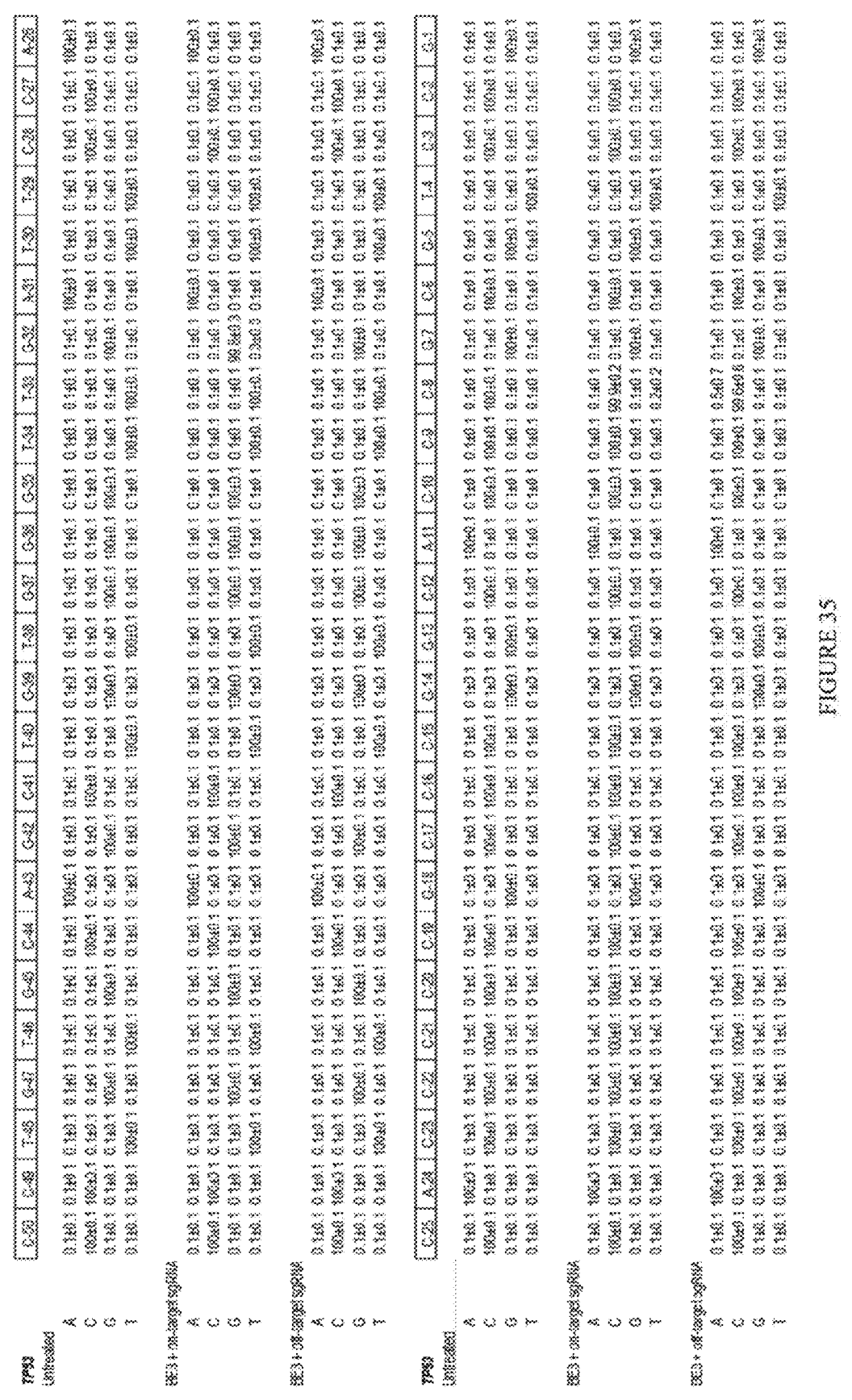
Figure 35:
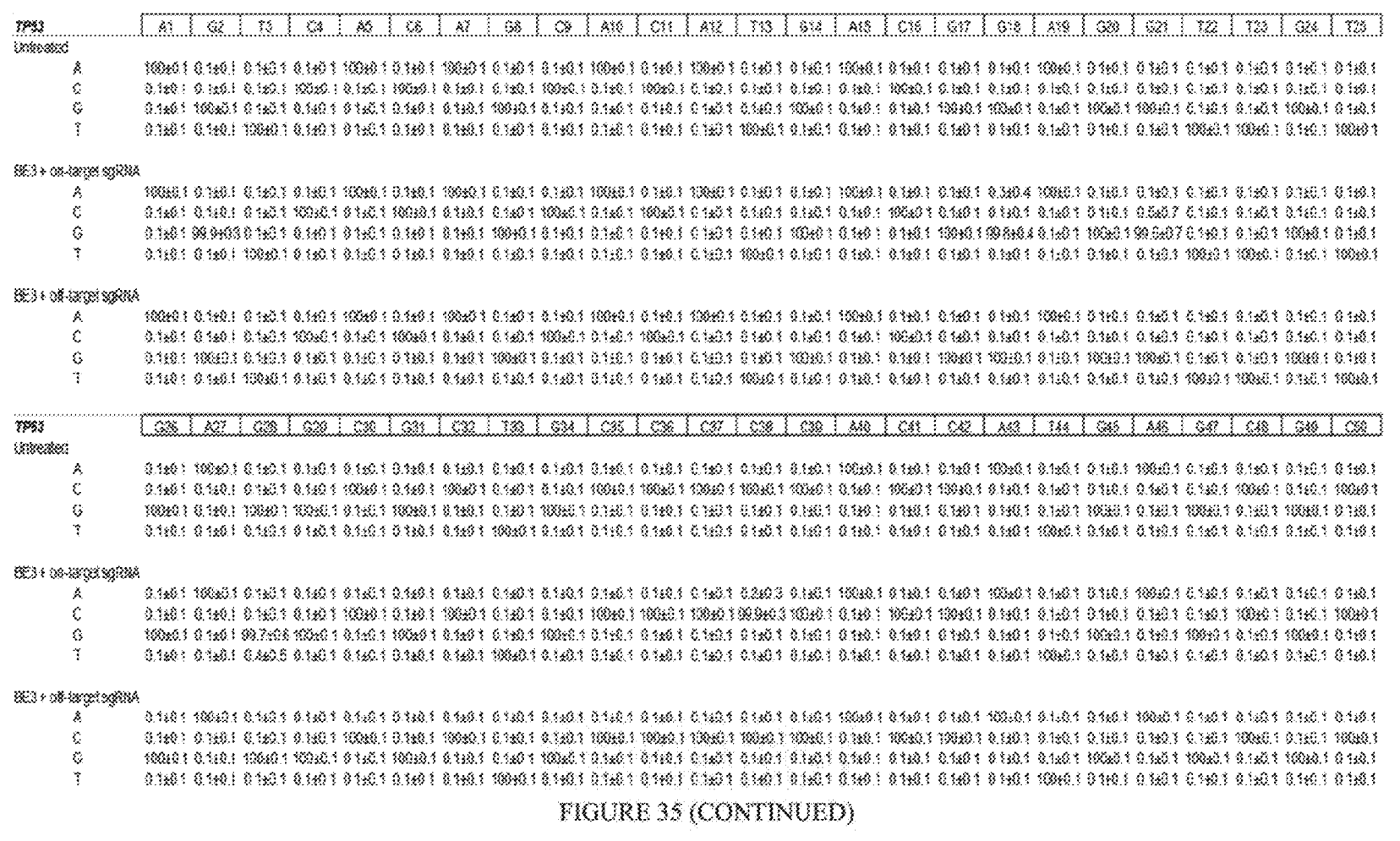
Figure 31:
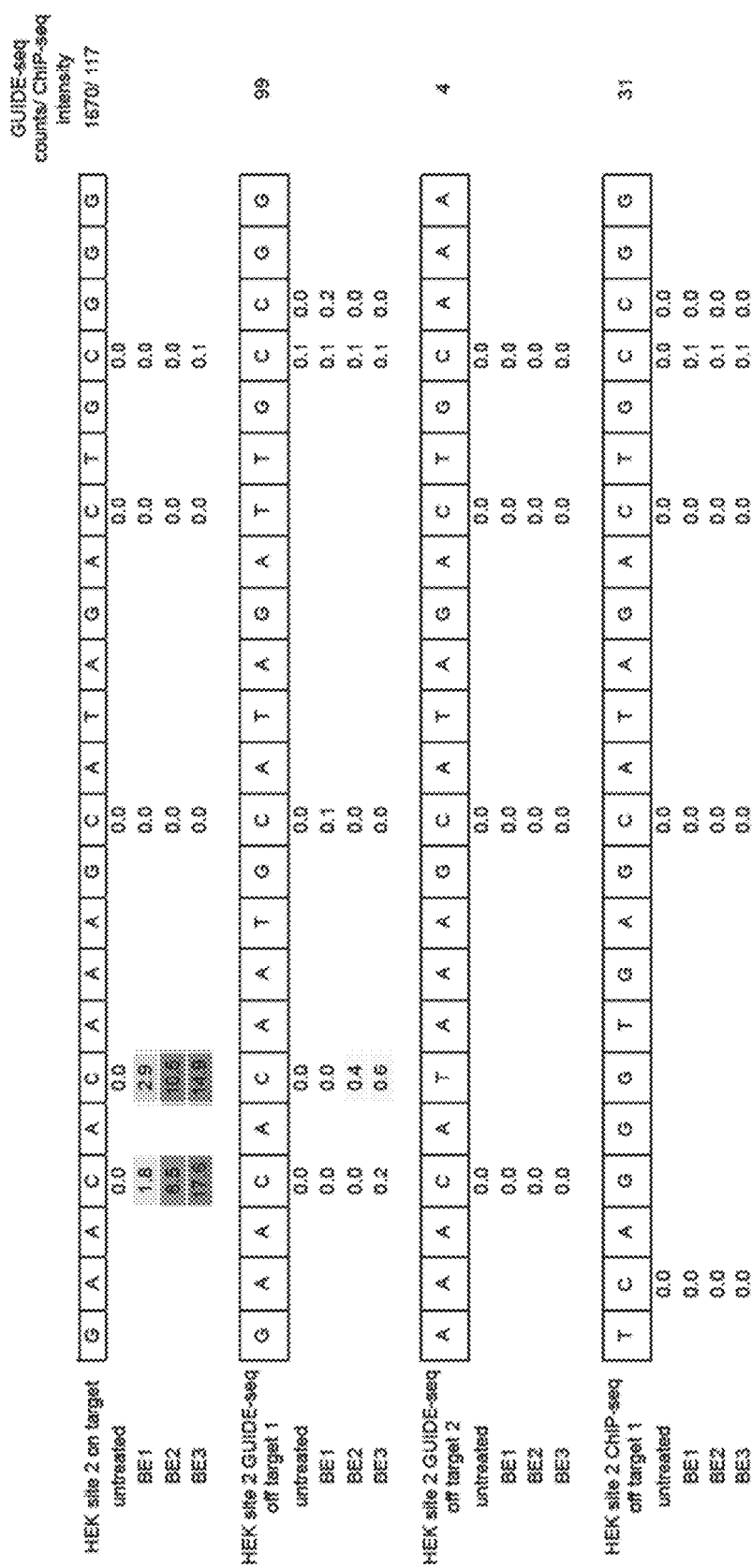
FIG. 31 shows activities of BE1, BE2, and BE3 at HEK293 site 2 off-targets. HEK293T cells were transfected with plasmids expressing BE1, BE2, or BE3 and a sgRNA matching the HEK293 site 2 sequence using Lipofectamine 2000. Three days after transfection, genomic DNA was extracted, amplified by PCR, and analyzed by high-throughput DNA sequencing at the on-target loci, plus all of the known Cas9 and dCas9 off-target loci for the HEK293 site 2 sgRNA, as previously determined by Joung and coworkers using the GUIDE-seq method (63), and Adli and coworkers using chromatin immunoprecipitation high-throughput sequencing (ChIP-seq) experiments (18). Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq intensity reported for each sequence. This figure depicts SEQ ID NOs: 295, 327 through 328 and 684 through 688 from top to bottom, respectively.
Figure 33:
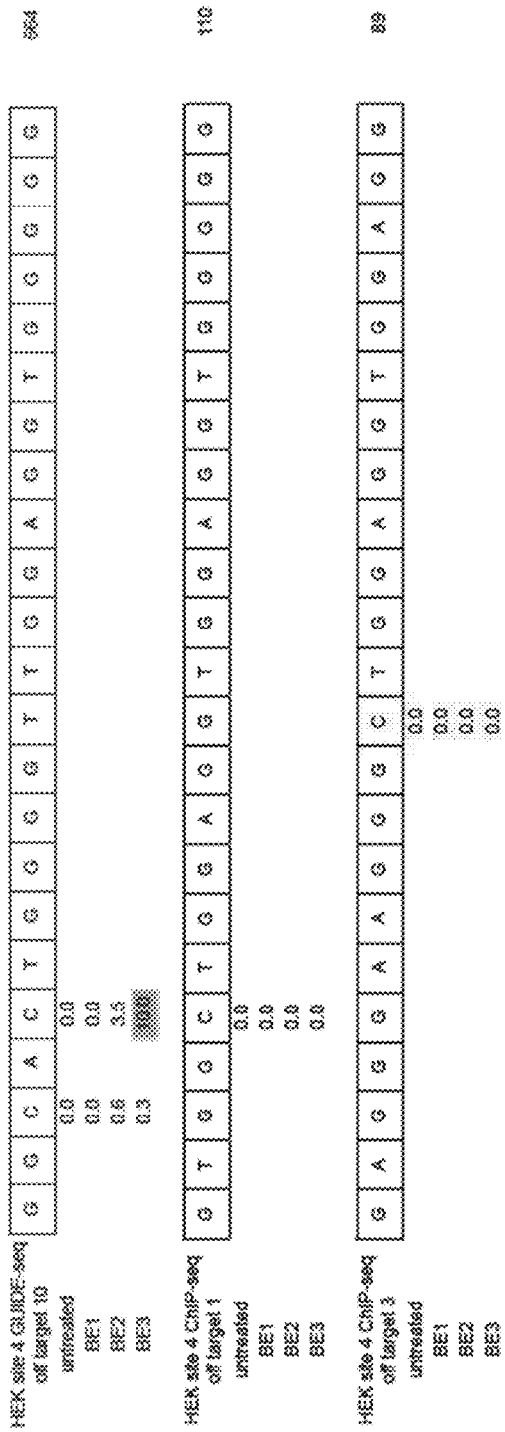
FIG. 33 shows activities of BE1, BE2, and BE3 at HEK293 site 4 off-targets. HEK293T cells were transfected with plasmids expressing BE1, BE2, or BE3 and a sgRNA matching the HEK293 site 4 sequence using Lipofectamine 2000. Three days after transfection, genomic DNA was extracted, amplified by PCR, and analyzed by high-throughput DNA sequencing at the on-target loci, plus the top ten known Cas9 off-target loci and the top five known dCas9 off-target loci for the HEK293 site 4 sgRNA, as previously determined using the GUIDE-seq method[54], and using chromatin immunoprecipitation high-throughput sequencing (ChIP-seq) experiments[61]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for BE1, BE2, and BE3. On the far right are displayed the total number of sequencing reads reported, and the ChIP-seq signal intensity reported for each sequence. This figure depicts SEQ ID NOs: 297, 664 through 673, 5783, and 5784 from top to bottom, respectively.

Finally, the potential of nucleobase editing to correct three disease-relevant mutations in mammalian cells was tested. The apolipoprotein E gene variant APOE4 encodes two Arg residues at amino acid positions 112 and 158, and is the largest and most common genetic risk factor for late-onset Alzheimer's disease.[64] ApoE variants with Cys residues in positions 112 or 158, including APOE2 (Cys112/Cys158), APOE3 (Cys112/Arg158), and APOE3' (Arg112/Cys158) have been shown[65] or are presumed[81] to confer substantially lower Alzheimer's disease risk than APOE4. Encouraged by the ability of NBE1 to convert APOE4 to APOE3' in vitro (FIGS. 16A to 16B), this conversion was attempted in immortalized mouse astrocytes in which the endogenous murine APOE gene has been replaced by human APOE4 (Taconic). DNA encoding NBE3 and an appropriate sgRNA was delivered into these astrocytes by nucleofection (nucleofection efficiency of 25%), extracted genomic DNA from all treated cells two days later, and measured editing efficiency by HTS. Conversion of Arg158 to Cys158 was observed in 58-75% of total DNA sequencing reads (44% of nucleofected astrocytes) (FIGS. 14A to 14C and FIGS. 30A). Also observed was 36-50% editing of total DNA at the third position of codon 158 and 38-55% editing of total DNA at the first position of Leu159, as expected since all three of these Cs are within the active nucleobase editing window. However, neither of the other two C→T conversions results in a change in the amino acid sequence of the ApoE3' protein since both TGC and TGT encode Cys, and both CTG and TTG encode Leu. From >1,500,000 sequencing reads derived from $1 \times 10^6$ cells evidence of 1.7% indels at the targeted locus following NBE3 treatment was observed (FIG. 35). In contrast, identical treatment of astrocytes with wt Cas9 and donor ssDNA resulted in 0.1-0.3% APOE4 correction and 26-40% indels at the targeted locus, efficiencies consistent with previous reports of single-base correction using Cas9 and HDR[45,75] (FIG. 30A and FIG. 40A). Astrocytes treated identically but with an sgRNA targeting the VEGFA locus displayed no evidence of APOE4 base editing (FIG. 34 and FIG. 40A). These results demonstrate how nucleobase editors can effect precise, single-amino acid changes in the coding sequence of a protein as the major product of editing, even when their processivity results in more than one nucleotide change in genomic DNA. The off-target activities of Cas9, dCas9, and Cas9 nickase have been extensively studied.[54, 60-62] In general, off-target C to T conversions by BE1, BE2, and BE3 paralleled off-target Cas9 nuclease-mediated genome modification frequencies.

Figure 30B:
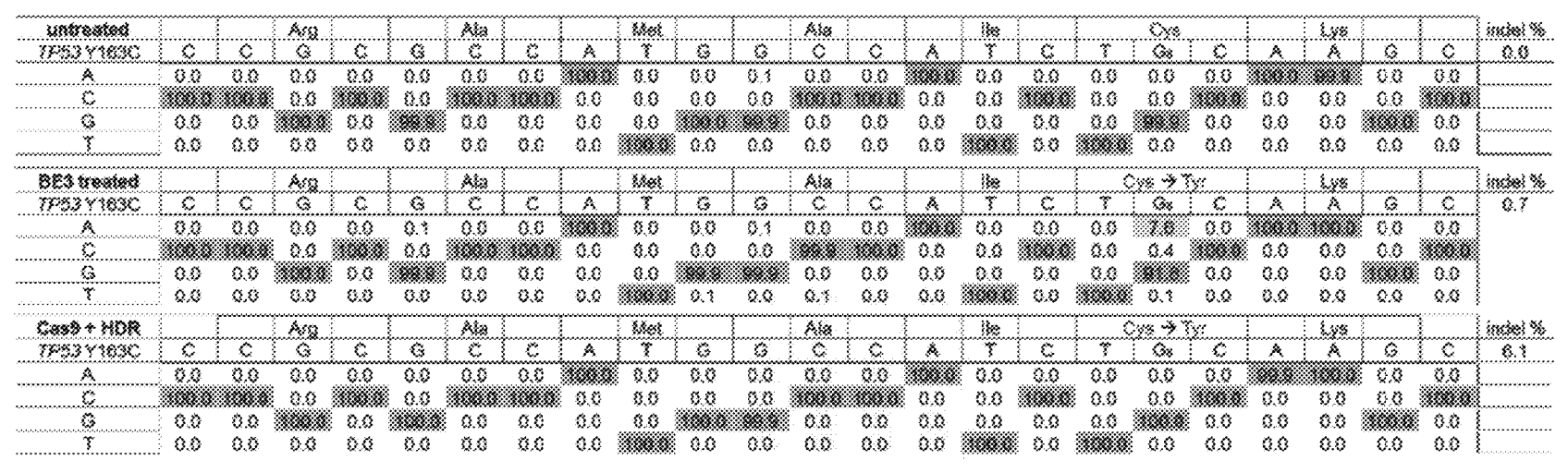

The dominant-negative p53 mutations Tyr163Cys and Asn239Asp are strongly associated with several types of cancer.[66-67] Both of these mutations can be corrected by a C to T conversion on the template strand (FIGS. 16A to 16B). A human breast cancer cell line homozygous for the p53 Tyr163Cys mutation (HCC1954 cells) was nucleofected with DNA encoding NBE3 and an sgRNA programmed to correct Tyr163Cys. Because the nucleofection efficiency of HCC1954 cells was <10%, a plasmid expressing IRFP was co-nucleofected into these cells to enable isolation of nucleofected cells by fluorescence-activated cell sorting two days after treatment. HTS of genomic DNA revealed correction of the Tyr163Cys mutation in 7.6% of nucleofected HCC1954 cells (FIG. 30B and FIG. 40A to 40B). Also nucleofected was a human lymphoma cell line that is heterozygous for p53 Asn239Asp (ST486 cells) with DNA encoding NBE2 and an sgRNA programmed to correct Asn239Asp with 92% nucleofection efficiency). Correction of the Asn239Asp mutation was observed in 11% of treated ST486 cells (12% of nucleofected ST486 cells). Consistent with the findings in HEK cells, no indels were observed from the treatment of ST486 cells with NBE2, and 0.6% indel formation from the treatment of HCC1954 cells with NBE3. No other DNA changes within at least 50 base pairs of both sides of the protospacer were detected at frequencies above that of untreated controls out of >2,000,000 sequencing reads derived from 2×10$^5$ cells (FIGS. 14A to 14C, FIG. 30B and Table 1). These results collectively represent the conversion of three disease-associated alleles in genomic DNA into their wild-type forms with an efficiency and lack of other genome modification events that is, to our knowledge, not currently achievable using other methods.

Figure 21:
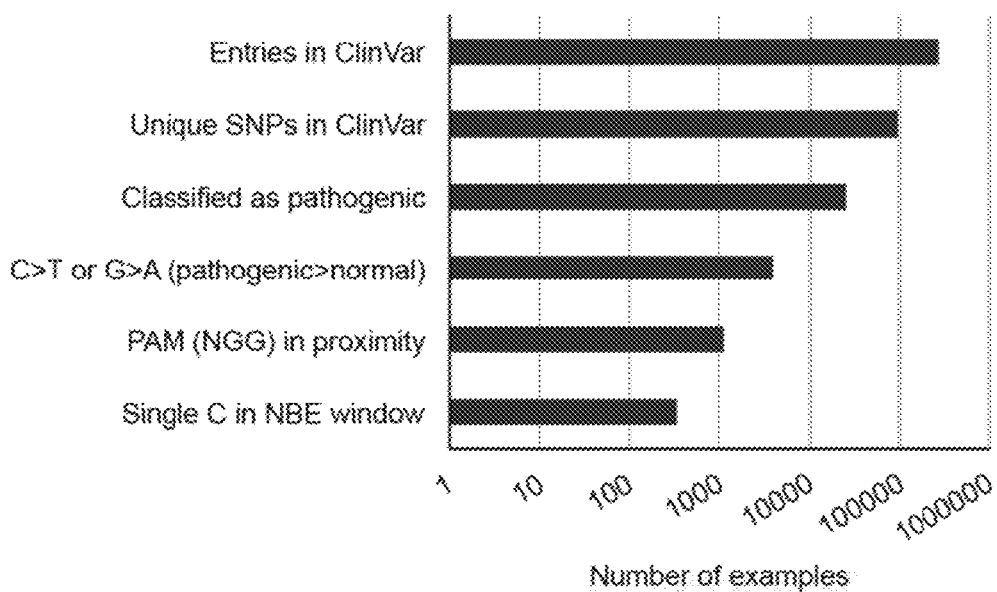
FIG. 21 shows genetic variants from ClinVar that can be corrected in principle by nucleobase editing. The NCBI ClinVar database of human genetic variations and their corresponding phenotypes[68] was searched for genetic diseases that can be corrected by current nucleobase editing technologies. The results were filtered by imposing the successive restrictions listed on the left. The x-axis shows the number of occurrences satisfying that restriction and all above restrictions on a logarithmic scale.
Figure 23:
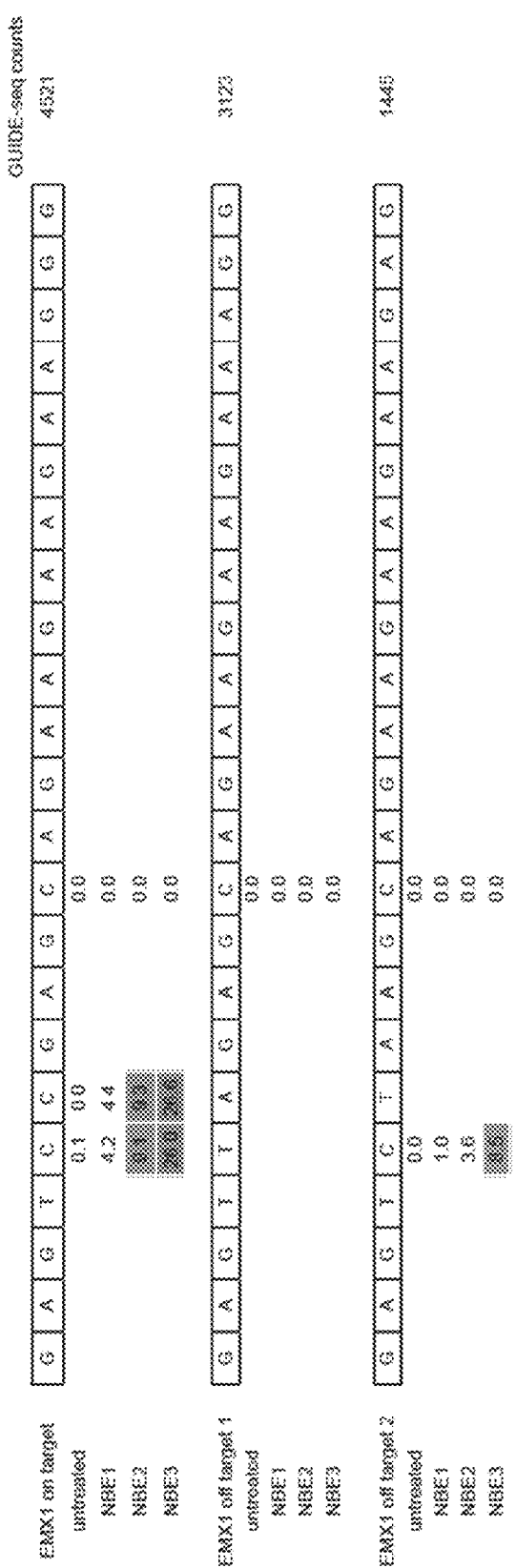
FIG. 23 shows activities of NBE1, NBE2, and NBE3 at EMX1 off-targets. HEK293T cells were transfected with plasmids expressing NBE1, NBE2, or NBE3 and a sgRNA matching the EMX1 sequence using Lipofectamine 2000. Three days after transfection, genomic DNA was extracted, amplified by PCR, and analyzed by high-throughput DNA sequencing at the on-target loci, plus the top ten known Cas9 off-target loci for the EMX1 sgRNA, as previously determined using the GUIDE-seq method[55]. EMX1 off-target 5 locus did not amplify and is not shown. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 293, and 5767 through 5775 from top to bottom, respectively.
Figure 25:
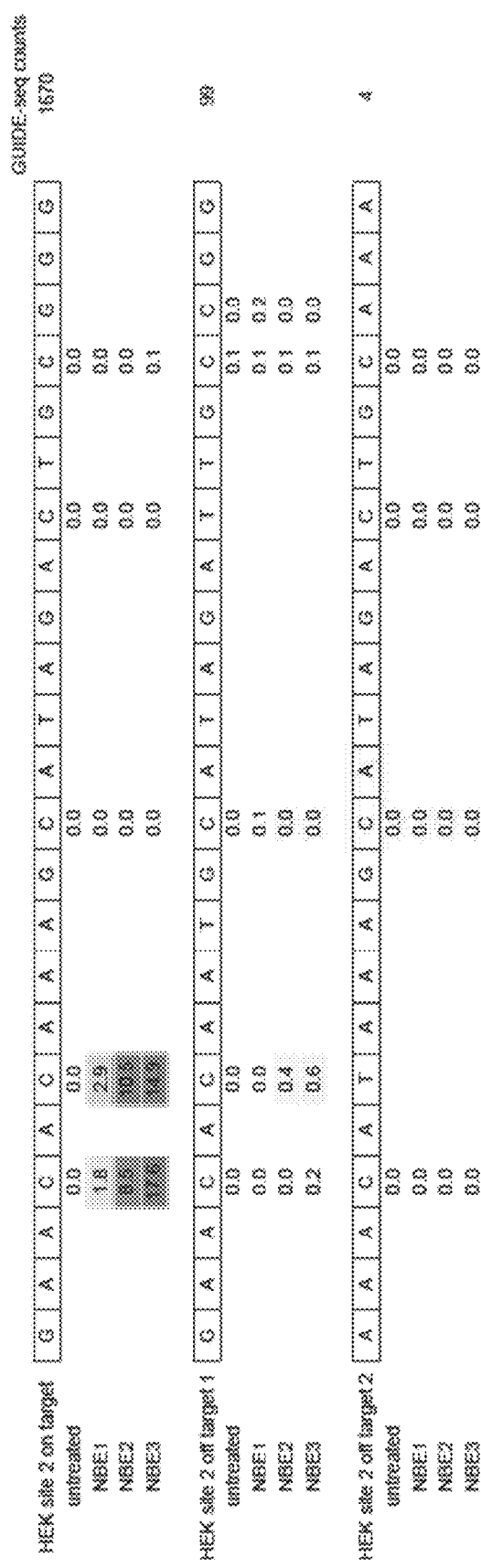
FIG. 25 shows activities of NBE1, NBE2, and NBE3 at HEK293 site 2 off-targets. HEK293T cells were transfected with plasmids expressing NBE1, NBE2, or NBE3 and a sgRNA matching the HEK293 site 2 sequence using Lipofectamine 2000. Three days after transfection, genomic DNA was extracted, amplified by PCR, and analyzed by high-throughput DNA sequencing at the on-target loci, plus all of the known Cas9 off-target loci for the HEK293 site 2 sgRNA, as previously determined using the GUIDE-seq method[55]. Sequences of the on-target and off-target protospacers and protospacer adjacent motifs (PAMs) are displayed. Cellular C to T conversion percentages, defined as the percentage of total DNA sequencing reads with T at each position of an original C within the protospacer, are shown for NBE1, NBE2, and NBE3. On the far right are displayed the total number of sequencing reads reported for each sequence. This figure depicts SEQ ID NOs: 295, 327, and 328 from top to bottom, respectively.

To illuminate the potential relevance of nucleobase editors to address human genetic diseases, the NCBI ClinVar database[68] was searched for known genetic diseases that could in principle be corrected by this approach. ClinVar was filtered by first examining only single nucleotide polymorphisms (SNPs), then removing any nonpathogenic variants. Out of the 24,670 pathogenic SNPs, 3,956 are caused by either a T to C, or an A to G, substitution. This list was further filtered to only include variants with a nearby NGG PAM that would position the SNP within the deamination activity window, resulting in 1,089 clinically relevant pathogenic gene variants that could in principle be corrected by the nucleobase editors described here (FIG. 21 and Table 1). To illuminate the potential relevance of base editors to address human genetic diseases, the NCBI ClinVar database[68] was searched for known genetic diseases that could in principle be corrected by this approach. ClinVar was filtered by first examining only single nucleotide polymorphisms (SNPs), then removing any non-pathogenic variants. Out of the 24,670 pathogenic SNPs, 3,956 are caused by either a T to C, or an A to G, substitution. This list was further filtered to only include variants with a nearby NGG PAM that would position the SNP within the deamination activity window, resulting in 911 clinically relevant pathogenic gene variants that could in principle be corrected by the base editors described here. Of these, 284 contain only one C within the base editing activity window. A detailed list of these pathogenic mutations can be found in Table 1.

TABLE 1

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 755445790 | NM_000391.3(TPP1): c.887-10A > 22G | TTTYTTTTTTTTTTTTTGAGG | Ceroid lipofuscinosis, neuronal, 2 |
| 113994167 | NM_000018.3(ACADVL): c.848T > 22C (p.Val283Ala) | TTTGYGGTGGAGAGGGGCTTCGG, TTGYGGTGGAGAGGGGCTTCGGG | Very long chain acyl-CoA dehydrogenase deficiency |
| 119470018 | NM_024996.5(GFM1): c.521A > 22G (p.Asn174Ser) | TTGYTAATAAAAGTTAGAAACGG | Combined oxidative phosphorylation deficiency 1 |
| 115650537 | NM_000426.3(LAMA2): c.8282T > 22C (p.Ile2761Thr) | TTGAYAGGGAGCAAGCAGTTCGG, TGAYAGGGAGCAAGCAGTTCGGG | Merosin deficient congenital muscular dystrophy |
| 587777752 | NM_014946.3(SPAST): c.1688- | TTCYGTAAAACATAAAAGTCAGG | Spastic paraplegia 4, autosomal dominant |
| 794726821 | NM_001165963.1(SCN1A): c.4055T > C (p.Leu1352Pro) | TTCYGGTTTGTCTTATATTCTGG | Severe myoclonic epilepsy in infancy |
| 397514745 | NM_001130089.1(KARS): c.517T > 22C (p.Tyr173His) | CTTCYATGATCTTCGAGGAGAGG, TTCYATGATCTTCGAGGAGAGGG | Deafness, autosomal recessive 89 |
| 376960358 | NM_001202.3(BMP4): c.362A > 22G (p.His121Arg) | TTCGTGGYGGAAGCTCCTCACGG | Microphthalmia syndromic 6 |
| 606231280 | NM_001287223.1(SCN11A): c.42T > 22C (p.Ile381Thr) | CTTCAYTGTGGTCATTTTCCTGG, TTCAYTGTGGTCATTTTCCTGGG | Episodic pain syndrome, familial, 3 |
| 387906735 | m.608A > 22G | TTCAGYGTATTGCTTTGAGGAGG | |
| 199474663 | m.3260A > 22G | TTAAGTTYTATGCGATTACCGGG | Cardiomyopathy with or without skeletal myopathy |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
| --- | --- | --- | --- |
| 104894962 | NM_003413.3(ZIC3):c.1213A > 22G (p.Lys405Glu) | TGTGTTYGCGCAGGGAGCTCGGG, ATGTGTTYGCGCAGGGAGCTCG G | Heterotaxy, visceral, X-linked |
| 796053181 | NM_021007.2(SCN2A):c.1271T > 22C (p.Val424Ala) | TGTGGYGGCCATGGCCTATGAGG | not provided |
| 267606788 | NM_000129.3(F13A1):c.728T > 22C (p.Met243Thr) | TGTGAYGGACAGAGCACAAATGG | Factor xiii, a subunit, deficiency of |
| 397514503 | NM_003863.3(DPM2):c.68A > 22G (p.Tyr23Cys) | TGTAGYAGGTGAAGATGATCAGG | Congenital disorder of glycosylation type 1u |
| 104893973 | NM_000416.2(IFNGR1):c.260T > 22C (p.Ile87Thr) | TGTAATAYTTCTGATCATGTTGG | Disseminated atypical mycobacterial infection, Mycobacterium tuberculosis, susceptibility to |
| 121908466 | NM_005682.6(ADGRG1):c.263A > G (p.Tyr88Cys) | TGGYAGAGGCCCCTGGGGTCAGG | Polymicrogyria, bilateral frontoparietal |
| 147952488 | NM_002437.4(MPV17):c.186 + 302T > 22C | TGGYAAGTTCTCCCCTCAACAGG | Navajo neurohepatopathy |
| 121909537 | NM_001145.4(ANG):c.121A > 22G (p.Lys41Glu) | TGGTTYGGCATCATAGTGCTGGG, GTGGTTYGGCATCATAGTGCTG G | Amyotrophic lateral sclerosis type 9 |
| 121918489 | NM_000141.4(FGFR2):c.1018T > 22C (p.Tyr340His) | TGGGGAAYATACGTGCTTGGCGG, GGGGAAYATACGTGCTTGGCGGG | Crouzon syndrome |
| 121434463 | m.12320A > 22G | GAGTYGCACCAAAATTTTTGGGG, GGAGTYGCACCAAAATTTTTGGG, TGGAGTYGCACCAAAATTTTTG G | Mitochondrial myopathy |
| 121908046 | NM_000403.3(GALE):c.101A > 22G (p.Asn34Ser) | TGGAAGYTATCGATGACCACAGG | UDPglucose-4-epimerase deficiency |
| 431905512 | NM_003764.3(STX11):c.173T > 22C (p.Leu58Pro) | TGCYGGTGGCCGACGTGAAGCGG | Hemophagocytic lymphohistiocytosis, familial, 4 |
| 121917905 | NM_000124.3(ERCC6):c.2960T > C (p.Leu987Pro) | TGCYAAAAGACCCAAAACAAAGG | Cerebro-oculo-facio-skeletal syndrome |
| 121918500 | NM_000141.4(FGFR2):c.874A > 22G (p.Lys292Glu) | TGCTYGATCCACTGGATGTGGGG, GTGCTYGATCCACTGGATGTGGG, CGTGCTYGATCCACTGGATGTG G | Crouzon syndrome |
| 60431989 | NM_000053.3(ATP7B):c.3443T > 22C (p.Ile1148Thr) | TGCTGAYTGGAAACCGTGAGTGG | Wilson disease |
| 78950939 | NM_000250.1(MPO):c.518A > 22G (p.Tyr173Cys) | GTGCGGYATTTGTCCTGCTCCGG, TGCGGYATTTGTCCTGCTCCGG G | Myeloperoxidase deficiency |
| 115677373 | NM_201631.3(TGM5):c.763T > 22C (p.Trp255Arg) | TGCGGAGYGGACGGGCAGCGTGG | Peeling skin syndrome, acral type |
| 5030804 | NM_000551.3(VHL):c.233A > 22G (p.Asn78Ser) | GCGAYTGCAGAAGATGACCTGGG, TGCGAYTGCAGAAGATGACCTG G | Von Hippel-Lindau syndrome |
| 397508328 | NM_000492.3(CFTR):c.1A > 22G (p.Met1Val) | GCAYGGTCTCTCGGGCGCTGGGG, TGCAYGGTCTCTCGGGCGCTGGG, CTGCAYGGTCTCTCGGGCGCTGG | Cystic fibrosis |
| 137853299 | NM_000362.4(TIMP3):c.572A > 22G (p.Tyr191Cys) | TGCAGYAGCCGCCCTTCTGCCGG | Sorsby fundus dystrophy |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 121908549 | NM_000334.4(SNC4A):c.3478A > G (p.Ile1160Val) | TGAYGGAGGGGATGGCGCCTAGG | |
| 121909337 | NM_001451.2(FOXF1):c.1138T > 22C (p.Ter380Arg) | TGATGYGAGGCTGCCGCCGCAGG | Alveolar capillary dysplasia with misalignment of pulmonary veins |
| 281875320 | NM_005359.5(SMAD4):c.1500A > G (p.Ile500Met) | TGAGYATGCATAAGCGACGAAGG | Myhre syndrome |
| 730880132 | NM_170707.3(LMNA):c.710T > 22C (p.Phe237Ser) | TGAGTYTGAGAGCCGGCTGGCGG | Primary dilated cardiomyopathy |
| 281875322 | NM_005359.5(SMAD4):c.1498A > 22G (p.Ile500Val) | TGAGTAYGCATAAGCGACGAAGG | Hereditary cancer-predisposing syndrome, Myhre syndrome |
| 72556283 | NM_000531.5(OTC):c.527A > 22G (p.Tyr176Cys) | TGAGGYAATCAGCCAGGATCTGG | not provided |
| 74315311 | NM_020435.3(WC2):c.857T > 22C (p.Met286Thr) | TGAGAYGGCCCACCTGGGCTTGG, GAGAYGGCCCACCTGGGCTTGGG | Leukodystrophy, hypomyelinating, 2 |
| 121912495 | NM_170707.3(LMNA):c.1139T > 22C (p.Leu380Ser) | TCTYGGAGGGCGAGGAGGAGAGG | Congenital muscular dystrophy, LMNA-related |
| 128620184 | NM_000061.2(BTK):c.1288A > 22G (p.Lys430Glu) | TCTYGATGGCCACGTCGTACTGG | X-linked agammaglobulinemia |
| 118192252 | NM_004519.3(KCNQ3):c.1403A > 22G (p.Asn468Ser) | TCTTTAYTGTTTAAGCCAACAGG | Benign familial neonatal seizures 2, not specified |
| 121909142 | NM_001300.5(KLF6):c.190T > 22C (p.Trp64Arg) | TCTGYGGACCAAAATCATTCTGG | |
| 104895503 | NM_001127255.1(NLRP7):c.2738A > G (p.Asn913Ser) | TCTGGYTGATACTCAAGTCCAGG | Hydatidiform mole |
| 587783035 | NM_000038.5(APC):c.1744-2A > 22G | TCCYAGTAAGAAACAGAATATGG | Familial adenomatous polyposis 1 |
| 72556289 | NM_000531.5(OTC):c.541-2A > 22G | TCCYAAAAGGCACGGGATGAAGG | not provided |
| 28937313 | NM_005502.3(ABCA1):c.2804A > 22G (p.Asn935Ser) | TCCAYTGTGGCCCAGGAAGGAGG, CGCTCCAYTGTGGCCCAGGAAGG | Tangier disease |
| 143246552 | NM_001003811.1(TEX11):c.511A > 22G (p.Met171Val) | TCCAYGGTCAAGTCAGCCTCAGG, CCAYGGTCAAGTCAGCCTCAGGG | Spermatogenic failure, X-linked, 2 |
| 587776451 | NM_002049.3(GATA1):c.2T > 22C (p.Met1Thr) | CTCCAYGGAGTTCCCTGGCCTGG, TCCAYGGAGTTCCCTGGCCTGGG, CCAYGGAGTTCCCTGGCCTGGGG | GATA-1-related thrombocytopenia with dyserythropoiesis |
| 121908403 | NM_021102.3(SPINT2):c.488A > 22G (p.Tyr163Cys) | TCCAYAGATGAAGTTATTGCAGG | Diarrhea 3, secretory sodium, congenital, syndromic |
| 281874738 | NM_000495.4(COL4A5):c.438 + 302T > 22C | CTCCAGYAAGTTATAAAATTTGG, TCCAGYAAGTTATAAAATTTGGG | Alport syndrome, X-linked recessive |
| 730880279 | NM_030653.3(DDX11):c.2271 + 302T > 22C | TCCAGGYGCGGGCGTCATGCTGG, CCAGGYGCGGGCGTCATGCTGGG | Warsaw breakage syndrome |
| 28940272 | NM_017890.4(VPS13B):c.8978A > 22G (p.Asn2993Ser) | TCAYTGATAAGCAGGGCCCAGGG, TTCAYTGATAAGCAGGGCCCAGG | Cohen syndrome, not specified |
| 137852375 | NM_000132.3(F8):c.5372T > 22C (p.Met1791Thr) | TCAYGGTGAGTTAAGGACAGTGG | Hereditary factor VIII deficiency disease |
| 11567847 | NM_021961.5(TEAD1):c.1261T > 22C (p.Tyr-His) | TCATATTYACAGGCTTGTAAAGG | |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 786203989 | NM_016069.9(PAM16):c.226A > 22G (p.Asn76Asp) | CATAGTYCTGCAGAGGAGAGGGG, TCATAGTYCTGCAGAGGAGAGGG | Chondrodysplasia, megarbane-dagher-melki type |
| 587776437 | NC_012920.1:m.9478T > 22C | TCAGAAGYTTTTTCTTCGCAGG | Leigh disease |
| 121912474 | NM_000424.3(KRT5):c.20T > 22C (p.Val7Ala) | TCAGTGYGTCCTTCCGGAGCGG, CAAGTGYGTCCTTCCGGAGCGGG, AAGTGYGTCCTTCCGGAGCGGGG, AGTGYGTCCTTCCGGAGCGGGGG | Epidermolysis bullosa simplex, Koebner type |
| 104886461 | NM_020533.2(MCOLN1):c.406-2A > 22G | TACYGTGGGCAGAGAAGGGGAGG, AGGTACYGTGGGCAGAGAAGGGG, CAGGTACYGTGGGCAGAGAAGGG | Ganglioside sialidase deficiency |
| 104894275 | NM_000317.2(PTS):c.155A > 22G (p.Asn52Ser) | TAAYTGTGCCCATGGCCATTTGG | 6-pyruvoyl-tetrahydropterinsynthase deficiency |
| 587777562 | NM_015599.2(PGM3):c.737A > 22G (p.Asn246Ser) | TAAATGAYTGAGTTTGCCCTTGG | Immunodeficiency 23 |
| 121964906 | NM_000027.3(AGA):c.916T > 22C (p.Cys306Arg) | GTTATAYGTGCCAATGTGACTGG | Aspartylglycosaminuria |
| 28941769 | NM_000356.3(TCOF1):c.149A > 22G (p.Tyr50Cys) | GTGTGTAYAGATGTCCAGAAGGG | Treacher collins syndrome 1 |
| 121434464 | m.12297T > 22C | GTCYTAGGCCCCAAAAATTTGG | Cardiomyopathy, mitochondrial |
| 121908407 | NM_054027.4(ANKH):c.143T > 22C (p.Met48Thr) | GTCGAGAYGCTGGCCAGCTACGG, TCGAGAYGCTGGCCAGCTACGGG | Chondrocalcinosis 2 |
| 59151893 | NM_000422.2(KRT17):c.275A > 22G (p.Asn92Ser) | GTCAYTGAGGTTCTGCATGGTGG, GCGGTCAYTGAGGTTCTGCATGG | Pachyonychia congenita type 2 |
| 121909499 | NM_002427.3(MMP13):c.272T > 22C (p.Met91Thr) | GTCAYGAAAAAGCCAAGATGCGG, TCAYGAAAAAGCCAAGATGCGGG | |
| 61748478 | NM_000552.3(VWF):c.2384A > 22G (p.Tyr795Cys) | GTCAYAGTTCTGGCACGTTTTGG | von Willebrand disease type 2N |
| 387906889 | NM_006796.2(AFG3L2):c.1847A > 22G (p.Tyr616Cys) | GTAYAGAGGTATTGTTCTTTTGG | Spastic ataxia 5, autosomal recessive |
| 118203907 | NM_000130.4(F5):c.5189A > 22G (p.Tyr1730Cys) | GTAGYAGGCCCAAGCCCGACAGG | Factor V deficiency |
| 118203945 | NM_013319.2(UBIAD1):c.305A > 22G (p.Asn102Ser) | GTAAGTGYTGACCAAATTACCGG | Schnyder crystalline conical dystrophy |
| 267607080 | NM_005633.3(SOS1):c.1294T > 22C (p.Trp432Arg) | GGTYGGGAGGGAAAAGACATTGG | Noonan syndrome 4, Rasopathy |
| 137852953 | NM_012464.4(TLL1):c.1885A > 22G (p.Ile629Val) | GGTTAYGGTGCCGTTAAGTTTGG | Atrial septal defect 6 |
| 118203949 | NM_013319.2(UBIAD1)c:.695A > G (p.Asn232Ser) | GGTGTTGYTGGAATGGAGAATGG | Schnyder crystalline conical dystrophy |
| 137852952 | NM_012464.4(TLL1):c.713T > 22C (p.Val238Ala) | GGGATTGYTGTTCATGAATTGGG | Atrial septal defect 6 |
| 41460449 | m.3394T > 22C | GGCYATATACAACTACGCAAAGG | Leber optic atrophy |
| 80357281 | NM_007294.3(BRCA1):c.5291T > 22C (p.Leu1764Pro) | GGGCYAGAAATCTGTTGCTATGG, GGCYAGAAATCTGTTGCTATGGG | Familial cancer of breast, Breast-ovarian cancer, familial 1 |
| 5030764 | NM_000174.4(GP9):c.182A > 22G (p.Asn61Ser) | GGCTGYTGTTGGCCAGCAGAAGG | Bernard-Soulier syndrome type C |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 72556282 | NM_000531.5(OTC):c.526T > 22C (p.Tyr176His) | GGCTGATYACCTCACGCTCCAGG, GATYACCTCACGCTCCAGGTTGG | not provided |
| 121913594 | NM_000530.6(MPZ):c.242A > 22G (p.His81Arg) | GGCATAGYGGAAGATCTATGAGG | Charcot-Marie-Tooth disease type 1B |
| 587777736 | NM_017617.3(NOTCH1):c.1285T > 22C (p.Cys429Arg) | GGCAAGYGCATCAACACGCTGGG, GGGCAAGYGCATCAACACGCTGG | Adams-Oliver syndrome 1, Adams-Oliver syndrome 5 |
| 63750912 | NM_016835.4(MAPT):c.1839T > 22C (p.Asn613=) | GGATAAYATCAAACACGTCCCGG, GATAAYATCAAACACGTCCCGG G | Frontotemporal dementia |
| 121918075 | NM_000371.3(TTR):c.401A > 22G (p.Tyr134Cys) | GGAGYAGGGGCTCAGCAGGGCGG, ATAGGAGYAGGGGCTCAGCAGGG | Amyloidogenic transthyretin amyloidosis |
| 730882063 | NM_004523.3(KIF11):c.2547 + 302T > 22C | GGAGGYAATAACTTTGTAAGTGG | Microcephaly with or without chorioretinopathy, lymphedema, or mental retardation |
| 397516156 | NM_000257.3(MYH7):c.2546T > 22C (p.Met849Thr) | GGAGAYGGCCTCCATGAAGGAGG | Primary familial hypertrophic cardiomyopathy, |
| 118204430 | NM_000035.3(ALDOB):c.442T > 22C (p.Trp148Arg) | GGAAGYGGCGTGCTGTGCTGAGG | Hereditary fructosuria |
| 200198778 | NM_013382.5(POMT2):c.1997A > 22G (p.Tyr666Cys) | GGAAGYAGTGGTGGAAGTAGAGG | Congenital muscular dystrophy, Congenital muscular dystrophy-dystroglycanopathy with brain and eye anomalies, type A2, Muscular dystrophy, Congenital muscular dystrophy-dystroglycanopathy with mental retardation, type B2 |
| 754896795 | NM_004006.2(DMD):c.6982A > 22T (p.Lys2328Ter) | GCTTTTYTTCAAGCTGCCCAAGG | Duchenne muscular dystrophy, Becker muscular dystrophy, Dilated cardiomyopathy 3B |
| 148924904 | NM_000546.5(TP53):c.488A > 22G (p.Tyr163Cys) | GCTTGYAGATGGCCATGGCGCGG | Hereditary cancer-predisposing syndrome |
| 786204770 | NM_016035.4(COQ4):c.155T > 22C (p.Leu52Ser) | GCTGTYGGCCGCCGGCTCCGCGG | COENZYME Q10 DEFICIENCY, PRIMARY, 7 |
| 121909520 | NM_001100.3(ACTA1):c.350A > 22G (p.Asn117Ser) | CGGYTGGCCTTGGGATTGAGGGG, GCGGYTGGCCTTGGGATTGAGGG, CGCGGYTGGCCTTGGGATTGAGG | Nemaline myopathy 3 |
| 587776879 | NM_004656.3(BAP1):c.438-2A > 22G | GCCYGGGGAAAAACAGAGTCAGG | Tumor predisposition syndrome |
| 727504434 | NM_000501.3(ELN):c.890-2A > 22G | GCCYGAAAACACAGCCACAGAGG | Supravalvar aortic stenosis |
| 119455953 | NM_000391.3(TPP1):c.1093T > 22C (p.Cys365Arg) | GCCGGGYGTTGGTCTGTCTCTGG | Ceroid lipofuscinosis, neuronal, 2 |
| 121964983 | NM_000481.3(AMT):c.125A > 22G (p.His42Arg) | GCCAGGYGGAAGTCATAGAGCGG | Non-ketotic hyperglycinem a |
| 121908300 | NM_001005741.2(GBA):c.751T > 22C (p.Tyr251His) | GCCAGAYACTTTGTGAAGTAAGG, CCAGAYACTTTGTGAAGTAAGG | Gaucher disease, type 1 |
| 786205083 | NM_003494.3(DYSF):c.3443-33A > 22G | GCCAGAGYGAGTGGCTGGAGTGG | Limb-girdle muscular dystrophy, type 2B |
| 121908133 | NM_175073.2(APTX):c.602A > 22G (p.His201Arg) | GCCAAYGGTAACGGGCCTTTGGG, AGCCAAYGGTAACGGGCCTTTGG | Adult onset ataxia with oculomotor apraxia |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 587777195 | NM_005017.3(PCYT1A):c.571T > 22C (p.Phe191Leu) | GCATGYTTGCTCCAACACAGAGG | Spondylometaphyseal dysplasia with cone-rod dystrophy |
| 431905520 | NM_014714.3(IFT140):c.4078T > 22C (p.Cys1360Arg) | CAAGCAGYGTGAGCTGCTCCTGG, GCAGYGTGAGCTGCTCCTGGAGG | Renal dysplasia, retinal pigmentary dystrophy, cerebellar ataxia and skeletal dysplasia |
| 121912889 | NM_001844.4(COL2A1):c.4172A > 22G (p.Tyr1391Cys) | GCAGTGGYAGGTGATGTTCTGGG | Spondyloperipheral dysplasia, Platyspondylic lethal skeletal dysplasia Torrance type |
| 137854492 | NM_001363.4(DKC1):c.I069A > 22G (p.Thr357Ala) | GCAGGYAGAGATGACCGCTGTGG | Dyskeratosis congenita X-linked |
| 121434362 | NM_152783.4(D2HGDH):c.1315A > 22G (p.Asn439Asp) | GCAGGYACCATCTCCTGGAGGG, TGCAGGYACCATCTCCTGGAGG | D-2-hydroxyglutaric aciduria 1 |
| 80338732 | NM_002764.3(PRPS1):c.344T > 22C (p.Met115Thr) | GCAAATAYGCTATCTGTAGCAGG | Charcot-Marie-Tooth disease, X-linked recessive, type 5 |
| 387906675 | NM_000313.3(PROS1):c.701A > 22G (p.Tyr234Cys) | GATTAYATCTGTAGCCTTCGGGG, AGATTAYATCTGTAGCCTTCGGG, GAGATTAYATCTGTAGCCTTCGG | Thrombophilia due to protein S deficiency, autosomal recessive |
| 28935478 | NM_000061.2(BTK):c.1082A > 22G (p.Tyr361Cys) | GATGGYAGTTAATGAGCTCAGGG, TGATGGYAGTTAATGAGCTCAGG | |
| 201777056 | NM_005050.3(ABCD4):c.956A > 22G (p.Tyr319Cys) | GATGAGGYAGATGCACACAAAGG | METHYLMALONIC ACIDURIA AND HOMOCYSTINURIA, cblJ |
| 121918528 | NM_000098.2(CPT2):c.359A > 22G (p.Tyr120Cys) | GATAGGYACATATCAAACCAGGG, AGATAGGYACATATCAAACCAGG | Carnitine palmitoyltransferase II deficiency, infantile |
| 267607014 | NM_002942.4(ROBO2):c.2834T > 22C (p.Ile945Thr) | GAGAYTGGAAATTTTGGCCGTGG | Vesicoureteral reflux 2 |
| 281865192 | NM_025114.3(CEP290):c.2991 > + 1655A > 22G | GATAYTCACAATTACAACTGGGG, AGATAYTCACAATTACAACTGGG, GAGATAYTCACAATTACAACTG | Leber congenital amaurosis 10 |
| 386833492 | NM_000112.3(SLC26A2):c.- 26 + 2T > C | GAGAGGYGAGAAGAGGGAAGCGG | Diastrophic dysplasia |
| 587779773 | NM_001101.3(ACTB):c.356T > 22C (p.Met119Thr) | GAGAAGAYGACCCAGGTGAGTGG | Baraitser-Winter syndrome 1 |
| 121913512 | NM_000222.2(KIT):c.1924A > 22G (p.Lys642Glu) | GACTTYGAGTTCAGACATGAGGG, GGACTTYGAGTTCAGACATGAGG | |
| 28939072 | NM_006329.3(FBLN5):c.506T > 22C (p.Ile169Thr) | GACAYTGATGAATGTCGCTATGG | Age-related macular degeneration 3 |
| 104894248 | NM_000525.3(KCNJ11):c.776A > 22G (p.His259Arg) | GACAYGGTAGATGATCAGCGGGG, TGACAYGGTAGATGATCAGCGGG, ATGACAYGGTAGATGATCAGCGG | Islet cell hyperplasia |
| 387907132 | NM_016464.4(TMEM138):c.287A > 22G (p.His96Arg) | GACAYGAAGGGAGATGCTGAGGG, AGACAYGAAGGGAGATGCTGAGG | Joubert syndrome 16 |
| 121918170 | NM_000275.2(OCA2):c.1465A > 22G (p.Asn489Asp) | GACATYTGGAGGGTCCCCGATGG | Tyrosinase-positive oculocutaneous albinism |
| 122467173 | NM_014009.3(FOXP3):c.970T > 22C (p.Phe324Leu) | GACAGAGYTCCTCCACAACATGG | Insulin-dependent diabetes mellitus secretory diarrhea syndrome |
| 137852268 | NM_000133.3(F9):c.1328T > 22C (p.Ile443Thr) | GAAYATATACCAAGGTATCCCGG | Hereditary factor IX deficiency disease |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 149054177 | NM_001999.3(FBN2):c.3740T > 22C (p.Met1247Thr) | GAATGTAYGATAATGAACGGAGG | not specified, Macular degeneration, early-onset |
| 137854488 | NM_212482.1(FN1):c.2918A > 22G (p.Tyr973Cys) | GAAGTAAYAGGTGACCCCAGGGG | Glomerulopathy with fibronectin deposits 2 |
| 786204027 | NM_005957.4(MTHFR):c.1530 + 302T > 22C | GAAGGYGTGGTAGGGAGGCACGG, AAGGYGTGGTAGGGAGGCACGGG, AGGGYGTGGTAGGGAGGCACGGGG | Homocystenemia due to MTHFR deficiency |
| 104894223 | NM_012193.3(FZD4):c.766A > 22G (p.Ile256Val) | GAAATAYGATGGGGCGCTCAGGG, AGAAATAYGATGGGGCGCTCAGG | Retinopathy of prematurity |
| 137854474 | NM_000138.4(FBN1):c.3793T > 22C (p.Cys1265Arg) | CTTGYGTTATGATGGATTCATGG | Madan syndrome |
| 587784418 | NM_006306.3(SMC1A):c.3254A > 22G (p.Tyr1085Cys) | CTTAYAGATCTCATCAATGTTGG | Congenital muscular hypertrophy-cerebral syndrome |
| 81002805 | NM_000059.3(BRCA2):c.316 + 302T > 22C | CTTAGGYAAGTAATGCAATATGG | Familial cancer of breast, Breast-ovarian cancer, familial 2, Hereditary cancer-predisposing syndrome |
| 121909653 | NM_182925.4(FLT4):c.3104A > 22G (p.His1035Arg) | CTGYGGATGCACTGGGGTGCGGG, TCTGYGGATGCACTGGGGTGCGG | |
| 786205107 | NM_031226.2(CYP19A1):c.743 + 302T > 22C | CTGTGYAAGTAATACAACTTTGG | Aromatase deficiency |
| 587777037 | NM_001283009.1(RTEL1):c.3730T > 22C (p.Cys1244Arg) | CTGTGTGYGCCAGGGCTGTGGGG | Dyskeratosis congenita, autosomal recessive, 5 |
| 794728380 | NM_000238.3(KCNH2):c.1945 > 306T > 22C | CTGTGAGYGTGCCCAGGGGCGGG, TGAGYGTGCCCAGGGGCGGGCGG | Cardiac arrhythmia |
| 267607987 | NM_000251.2(MSH2):c.2005 + 302T > 22C | CTGGYAAAAAACCTGGTTTTTGG, TGGYAAAAAACCTGGTTTTTGGC | Hereditary Nonpolyposis Colorectal Neoplasms |
| 397509397 | NM_006876.2(B4GAT1):c.1168A > 22G (p.Asn390Asp) | TGATYTTCAGCCTCCTTTTGGGG, CTGATYTTCAGCCTCCTTTTGGG, GCTGATYTTCAGCCTCCTTTTGG | Congenital muscular dystrophy-dystroglycanopathy with brain and eye anomalies, type A13 |
| 121918381 | NM_000040.1(APOC3):c.280A > 22G (p.Thr94Ala) | CTGAAGYTGGTCTGACCTCAGGG, GCTGAAGYTGGTCTGACCTCAGG | |
| 104894919 | NM_001015877.1(PHF6):c.769A > 22G (p.Arg257Gly) | CTCYTGATGTTGTTGTGAGCTGG | Borjeson-Forssman-Lehmann syndrome |
| 267606869 | NM_005144.4(HR):c.-218A > 22G | CTCYAGGGCCGCAGGTTGGAGGG, GCTCYAGGGCCGCAGGTTGGAGG, GGCGCTCYAGGGCCGCAGGTTGG | Marie Unna hereditary hypotrichosis 1 |
| 139732572 | NM_000146.3(FTL):c.1A > 22G (p.Met1Val) | CTCAYGGTTGGTTGGCAAGAAGG | L-ferritin deficiency |
| 397515418 | NM_018486.2(HDAC8):c.1001A > 22G (p.His334Arg) | CTCAYGATCTGGGATCTCAGAGG | Cornelia de Lange syndrome 5 |
| 372395294 | NM_000431.3(MVK):c.803T > C (p.Tyr416Cys) | CTCAYAGGCCATTGCGACCACGG | not provided |
| 104895304 | NM_000431.3(MVK):c.803T > 22C (p.Ile268Thr) | CTCAAYAGATGCCATCTCCCTGG | Hyperimmunoglobulin D with periodic fever, Mevalonic aciduria |
| 587777188 | NM_001165899.1(PDE4D):c.1850T > 22C (p.Ile617Thr) | CTATAYTGTTCATCCCCTCTGGG, ACTATAYTGTTCATCCCCTCTGG | Acrodysostosis 2, with or without hormone resistance |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 398123026 | NM_003867.3(FGF17):c.560A > 22G (p.Asn187Ser) | CGTGGYTGGGGAAGGGCAGCTGG | Hypogonadotropic hypogonadism 20 with or without anosmia |
| 121964924 | NM_001385.2(DPYS):c.1078T > 22C (p.Trp360Arg) | CGTAATAYGGGAAAAAGGCGTGG, AATAYGGGAAAAAGGCGTGGTGG, ATAYGGGAAAAAGGCGTGGTGGG | Dihydropyrimidinase deficiency |
| 587777301 | NM_199189.2(MATR3):c.1864A > 22G (p.Thr622Ala) | CGGYTGAACTCTCAGTCTTCTGG | Myopathy, distal, 2 |
| 200238879 | NM_000527.4(LDLR):c.694 + 302T > 22C | ACTGCGGYATGGGCGGGGCCAGG, CTGCGGYATGGGCGGGGCCAGGG, CGGYATGGGCGGGGCCAGGGTGG | Familial hypercholesterolemia |
| 142951029 | NM_145046.4(CALR3):c.245A > 22G (p.Lys82Arg) | CGGTYTGAAGCGTGCAGAGATGG | Arrhythmogenic right ventricular cardiomyopathy, Familial hypertrophic cardiomyopathy 19, Hypertrophic cardiomyopathy |
| 786200953 | NM_006785.3(MALT1):c.1019-2A > G | CGCYTTGAAAAAAAAGAAAGGG, TCGCYTTGAAAAAAAAGAAAG | Combined immunodeficiency |
| 120074192 | NM_000218.2(KCNQ1):c.418A > 22G (p.Ser140Gly) | CGCYGAAGATGAGGCAGACCAGG | Atrial fibrillation, familial, 3, Atrial fibrillation |
| 267606887 | NM_005957.4(MTHFR)c:.971A > G (p.Asn324Ser) | CGCGGYTGAGGGTGTAGAAGTGG | Homocystinuria due to MTHFR deficiency |
| 118192117 | NM_000540.2(RYR1):c.1205T > 22C (p.Met402Thr) | CGCAYGATCCACAGCACCAATGG | Congenital myopathy with fiber type disproportion, Central core disease |
| 199473625 | NM_198056.2(SCN5A):c.4978A > 22G (p.Ile1660Val) | CGAYGTTGAAGAGGGCAGGCAGG, AGCCCGAYGTTGAAGAGGGCAGG | Brugada syndrome |
| 794726865 | NM_000921.4(PDE3A):c.1333A > 22G (p.Thr445Ala) | CGAGGYGGTGGTGGTCCAAGTGG | Brachydactyly with hypertension |
| 606231254 | NM_005740.2(DNAL4):c.153 > 302T > 22C | CGAGGYATTGCCAGCAGTGCAGG | Mirror movements 3 |
| 786204826 | NM_004771.3(MMP20):c.611A > 22G (p.His204Arg) | CGAAAYGTGTATCTCCTCCCAGG | Amelogenesis imperfecta, hypomaturation type, IIA2 |
| 796053139 | NM_021007.2(SCN2A):c.4308 + 302T > 22C | CGAAATGYAAGTCTAGTTAGAGG, GAAATGYAAGTCTAGTTAGAGG | not provided |
| 137854494 | NM_005502.3(ABCA1):c.4429T > 22C (p.Cys1477Arg) | CCTGTGYGTCCCCAGGGGCAGG, CTGTGYGTCCCCAGGGGCAGGG, TGTGYGTCCCCAGGGGCAGGGG, GTGYGTCCCCAGGGGCAGGGGG | Tangier disease |
| 786205144 | NM_001103.3(ACTN2):c.683T > C (p.Met228Thr) | CCTAAAAYGTTGGATGCTGAAGG | Dilated cardiomyopathy IAA |
| 199919568 | NM_007254.3(PNKP):c.1029 + 302T > 22C | CCGGYGAGGCCCTGGGGCGGGG, TCCGGYGAGGCCCTGGGGCGGG, ATCCGGYGAGGCCCTGGGGCGGG, GATCCGGYGAGGCCCTGGGGCGG | not provided |
| 28939079 | NM_018965.3(TREM2):c.401A > 22G (p.Asp134Gly) | TGAYCCAGGGGGTCTATGGGAGG, CGGTGAYCCAGGGGGTCTATGGG | Polycystic lipomembranous osteodysplasia with sclerosing leukoencephalopathy |
| 193302855 | NM_032520.4(GNPTG):c.610-2A > 22G | CCGGTGAYCCAGGGGGTCTATGG, CCCYGAAGGTGGAGGATGCAGGG, GCCCYGAAGGTGGAGGATGCAGG | Mucolipidosis III Gamma |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 111033708 | NM_000155.3(GALT):c.499T > 22C (p.Trp167Arg) | CCCTYGGGTGCAGGTTTGTGAGG | Deficiency of UDPglucose-hexose- 1-phosphate uridylyltransferase |
| 28933378 | NM_000174.4(GP9):c.70T > 22C (p.Cys24Arg) | CCCAYGTACCTGCCGCGCCCTGG | Bernard Soulier syndrome, Bernard-Soulier syndrome type C |
| 364897 | NM_000157.3(GBA):c.680A > 22G (p.Asn227Ser) | CCAYTGGTCTTGAGCCAAGTGGG, TCCAYTGGTCTTGAGCCAAGTGG | Gaucher disease, Subacute neuronopathic Gaucher disease, Gaucher disease, type 1 |
| 796052551 | NM_000833.4(GRIN2A):c.2449A > 22G (p.Met817Val) | CCAYGTTGTCAATGTCCAGCTGG | not provided |
| 63751006 | NM_002087.3(GRN):c.2T > 22C (p.Met1Thr) | CCAYGTGGACCCTGGTGAGCTGG | Frontotemporal dementia, ubiquitin-positive |
| 786203997 | NM_001031.4(RPS28):c.1A > 22G (p.Met1Val) | TGTCCAYGATGGCGGCGCGGCGG, CCAYGATGGCGGCGCGGCGGCGG | Diamond-Blackfan anemia with microtia and cleft palate |
| 121908595 | NM_002755.3(MAP2K1):c.389A > 22G (p.Tyr130Cys) | CCAYAGAAGCCCACGATGTACGG | Cardiofaciocutaneous syndrome 3, Rasopathy |
| 398122910 | NM_000431.3(MVK):c.1039 + 302T > 22C | CCAGGYATCCCGGGGGTAGGTGG, CAGGYATCCCGGGGGTAGGTGGG | Porokeratosis, disseminated superficial actinic 1 |
| 119474039 | NM_020365.4(EIF2B3):c.1037T > 22C (p.Ile346Thr) | CCAGAYTGTCAGCAAACACCTGG | Leukoencephalopathy with vanishing white matter |
| 587777866 | NM_000076.2(CDKN1C):c.*5 + 302T > 22C | CCAAGYGAGTACAGCGCACCTGG, CAAGYGAGTACAGCGCACCTGGG, AAGYGAGTACAGCGCACCTGGGG | Beckwith-W edemann syndrome |
| 121918530 | NM_005587.2(MEF2A):c.788A > 22G (p.Asn263Ser) | AGAYTACCACCACCTGGTGGAGG, CCAAGAYTACCACCACCTGGTGG | |
| 483352818 | NM_000211.4(ITGB2):c.1877 + 302T > 22C | CATGYGAGTGCAGGCGGAGCAGG | Leukocyte adhesion deficiency type 1 |
| 460184 | NM_000186.3(CFH):c.3590T > 22C (p.Val1197Ala) | CAGYTGAATTTGTGTGTAAACGG | Atypical hemolytic-uremic syndrome 1 |
| 121908423 | NM_004795.3(KL):c.578A > 22G (p.His193Arg) | CAGYGGTACAGGGTGACCACGGG, CCAGYGGTACAGGGTGACCACGG | |
| 281860300 | NM_005247.2(FGF3):c.146A > 22G (p.Tyr49Cys) | CAGYAGAGCTTGCGGCGCCGGGG, GCAGYAGAGCTTGCGGCGCCGGG, CGCAGYAGAGCTTGCGGCGCCGG | Deafness with labyrinthine aplasia microtia and microdontia (LAMM) |
| 28935488 | NM_000169.2(GLA):c.806T > 22C (p.Val269Ala) | CAGTTAGYGATTGGCAACTTTGG | Fabry disease |
| 587776514 | NM_173560.3(RFX6):c.380 + 302T > 22C | CAGTGGYGAGACTCGCCCGCAGG, AGTGGYGAGACTCGCCCGCAGGG | Mitchell-Riley syndrome |
| 104894117 | NM_178138.4(LHX3):c.332A > 22G (p.Tyr111Cys) | CAGGTGGYACACGAAGTCCTGGG | Pituitary hormone deficiency, combined 3 |
| 34878913 | NM_000184.2(HBG2):c.125T > 22C (p.Phe42Ser) | CAGAGGTYCTTTGACAGCTTTGG | Cyanosis, transient neonatal |
| 120074124 | NM_000543.4(SMPD1)Lc.911T > C (p.Leu304Pro) | AGCACYTGTGAGGAAGTTCCTGG, GCACYTGTGAGGAAGTTCCTGGG, CACYTGTGAGGAAGTTCCTGGGG | Sphingomyelin/cholesterol lipidosis, Niemann-Pick disease, type A, Niemann-Pick disease, type B |
| 281860272 | NM_005211.3(CSF1R):c.2320-2A > 22G | CACYGAGGGAAAGCACTGCAGGG, GCACYGAGGGAAAGCACTGCAGG | Hereditary diffuse leukoencephalopathy with spheroids |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 128624216 | NM_000033.3(ABCD1):c.443A > 22G (p.Asn148Ser) | CACTGYTGACGAAGGTAGCAGGG, GCACTGYTGACGAAGGTAGCAGG | Adrenoleukodystrophy |
| 398124257 | NM_012463.3(ATP6V0A2):c.825 + 2T > 22C | CACTGYGAGTAAGCTGGAAGTGG | Cutis laxa with osteodystrophy |
| 267606679 | NM_004183.3(BEST1):c.704T > 22C (p.Val235Ala) | CACTGGYGTATACACAGGTGAGG | Vitreoretinochoroidopathy dominant |
| 397514518 | NM_000344.3(SMN1):c.388T > 22C (p.Tyr130His) | CACTGGAYATGGAAATAGAGAGG | Kugelberg-Welanderd sease |
| 143946794 | NM_001946.3(DUSP6):c.566A > 22G (p.Asn189Ser) | CACTAYTGGGGTCTCGGTCAAGG | Hypogonadotropic hypogonadism 19 with or without anosmia |
| 397516076 | NM_000256.3(MYBPC3):c.821 + 302T > G | GCACGYGAGTGGCCATCCTCAGG, CACGYGAGTGGCCATCCTCAGGG | Familial hypertrophic cardiomyopathy 4, not specified |
| 149977726 | NM_001257988.1(TYMP):c.665A > 22G (p.Lys222Arg) | CACGAGTYTCTTACTGAGAATGG, GAGTYTCTTACTGAGAATGGAGG | |
| 121917770 | NM_003361.3(UMOD):c.383A > 22G (p.Asn128Ser) | CACAYTGACACATGTGGCCAGGG, CCACAYTGACACATGTGGCCAGG | Familial juvenile gout |
| 121909008 | NM_000492.3(CFTR):c.2738A > G (p.Tyr913Cys) | CACATAAYACGAACTGGTGCTGG | Cystic fibrosis |
| 137852819 | NM_003688.3(CASK):c.2740T > 22C (p.Trp914Arg) | CACAGYGGGTCCCTGTCTCCTGG, ACAGYGGGTCCCTGTCTCCTGGG | FG syndrome 4 |
| 74315320 | NM_024009.2(GM3):c.421A > 22G (p.Ile141Val) | CAAYGATGAGCTTGAAGATGAGG | Deafness, autosomal recessive |
| 80356747 | NM_001701.3(BAAT):c.967A > 22G (p.Ile323Val) | CAAYGAAGAGGAATTGCCCCTGG | Atypical hemolytic-uremic syndrome 1 |
| 180177324 | NM_012203.1(GRHPR):c.934A > (p.Asn312Asp) | CAAGTYGTTAGCTGCCAACAAGG | Primary hyperoxaluria, type II |
| 281860274 | NM_005211.3(CSF1R):c.2381T > 22C (p.Ile794Thr) | CAAGAYTGGGGACTTCGGGCTGG | Hereditary diffuse leukoencephalopathy with spheroids |
| 398122908 | NM_005334.2(HCFC1):c.-970T > 22C | CAAGAYGGCGGCTCCCAGGGAGG | Mental retardation 3, X-linked |
| 548076633 | NM_002693.2(POLG):c.3470 > G (p.Asn1157Ser) | CAAGAGGYTGGTGATCTGCAAGG | not provided |
| 120074146 | NM_000019.3(ACAT1):c.935T > 22C (p.Ile312Thr) | CAAGAAYAGTAGGTAAGGCCAGG | Deficiency of acetyl-CoA acetyltransferase |
| 397514489 | NM_005340.6(HINT1):c.250T > 22C (p.Cys84Arg) | CAAGAAAYGTGCTGCTGATCTGG, AAGAAAYGTGCTGCTGATCTGGG | Gamstorp-Wohlfart syndrome |
| 587783539 | NM_178151.2(DCX):c.2T > 22C (p.Met1Thr) | CAAAATAYGGAACTTGATTTTGG | Heterotopia |
| 104894765 | NM_005448.2(BMP15):c.704A > 22G (p.Tyr235Cys) | ATTGAAAYAGAGTAACAAGAAGG | Ovarian dysgenesis 2 |
| 137852429 | NM_000132.3(F8):c.1892A > 22G (p.Asn631Ser) | ATGYTGGAGGCTTGGAACTCTGG | Hereditary factor VIII deficiency disease |
| 72558441 | NM_000531.5(OTC):c.779T > 22C (p.Leu260Ser) | ATGTATYAATTACAGACACTTGG | not provided |
| 398123765 | NM_003494.3(DYSF):c.1284 + 302T > 22C | ATGGYAAGGAGCAAGGGAGCAGG | Limb-girdle muscular dystrophy, type 2B |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
| --- | --- | --- | --- |
| 387906924 | NM_020191.2(MRPS22):c.644T > 22C (p.Leu215Pro) | ATCYTAGGGTAAGGTGACTTAGG | Combined oxidative phosphorylation deficiency 5 |
| 397518039 | NM_206933.2(USH2A):c.8559-2A > 22G | ATCYAAAGCAAAAGACAAGCAGG | Retinitis pigmentosa, Usher syndrome, type 2A |
| 5742905 | NM_000071.2(CBS):c.833T > 22C (p.Ile278Thr) | ATCAYTGGGGTGGATCCCGAAGG, TCAYTGGGGTGGATCCCGAAGGG | Homocystinuria due to CBS deficiency, Homocystinuria, pyridoxine-responsive |
| 397507473 | NM_004333.4(BRAF):c.1403T > 22C (p.Phe468Ser) | ATCATYTGGAACAGTCTACAAGG, TCATYTGGAACAGTCTACAAGG | Cardiofaciocutaneous syndrome, Rasopathy |
| 786204056 | NM_000264.3(PTCH1):c.3168 + 302T > 22C | ATCATTGYGAGTGTATTATAAGG, TCATTGYGAGTGTATTATAAGGG, CATTGYGAGTGTATTATAAGGG | Gorlin syndrome |
| 72558484 | NM_000531.5(OTC):c.1005 + 302T > 22C | ATCATGGYAAGCAAGAAACAAGG | not provided |
| 199473074 | NM_000335.4(SCN5A):c.688A > 22G (p.Ile230Val) | ATAYAGTTTTCAGGGCCCGGAGG, CTGATAYAGTTTTCAGGGCCCGG | Brugada syndrome |
| 111033273 | NM_206933.2(USH2A):c.1606T > 22C (p.Cys536Arg) | ATATAGAYGCCTCTGCTCCCAGG | Usher syndrome, type 2A |
| 72556290 | NM_000531.5(OTC):c.542A > 22G (p.Glu181Gly) | ATAGTGTYCCTAAAAGGCACGGG | not provided |
| 121918711 | NM_004612.3(TGFBR1):c.1199A > G (p.Asp400Gly) | ATAGATGYCAGCACGTTTGAAGG | Loeys-Dietz syndrome 1 |
| 104886288 | NM_000495.4(COL4A5):c.4699T > 22C (p.Cys1567Arg) | AGTAYGTGAAGCTCCAGCTGTGG | Alport syndrome, X-linked recessive |
| 144637717 | NM_016725.2(FOLR1):c.493 + 302T > 22C | CTTCAGGYGAGGGCTGGGTGGG, AGGYGAGGGCTGGGTGGGCAGG | not provided |
| 72558492 | NM_000531.5(OTC):c.1034A > 22G (p.Tyr345Cys) | AGGTGAGYAATCTGTCAGCAGGG | not provided |
| 62638745 | NM_000121.3(EPOR):c.1460A > 22G (p.Asn487Ser) | AGGGYTGGAGTAGGGGCCATCGG | Acute myeloid leukemia, M6 type, Familial erythrocytosis, 1 |
| 387907021 | NM_031427.3(DNAL1):c.449A > 22G (p.Asn150Ser) | AGGGAYTGCCTACAAACACCAGG | Kartagener syndrome, Ciliary dyskinesia, primary, 16 |
| 397514488 | NM_001161581.1(POC1A):c.398T > 22C (p.Leu133Pro) | AGCYGTGGGACAAGAGCAGCCGG | Short stature, onycho-dysplasia, facial dysmorphism, and hypotrichosis |
| 154774633 | NM_017882.2(CLN6):c.200T > 22C (p.Leu67Pro) | AGCYGGTATTCCCTCTCGAGTGG | Adult neuronal ceroid lipofuscinosis |
| 111033700 | NM_000155.3(GALT):c.482T > 22C (p.Leu161Pro) | AGCYGGGTGCCCAGTACCCTTGG | Deficiency of UDPglucose-hexose-1-phosphate uridylyltransferase |
| 128621198 | NM_000061.2(BTK):c.1223T > 22C (p.Leu408Pro) | GAGCYGGGGACTGGACAATTTGG, AGCYGGGGACTGGACAATTTGGG | X-linked agammaglobulinem a |
| 137852611 | NM_000211.4(ITGB2):c.446T > 22C (p.Leu149Pro) | AGCYAGGTGGCGACCTGCTCCGG | Leukocyte adhesion deficiency |
| 121908838 | NM_003722.4(TP63):c.697A > 22G (p.Lys233Glu) | AGCTTYTTTGTAGACAGGCATGG | Split-hand/foot malformation 4 |
| 397515869 | NM_000169.2(GLA):c.1153A > 22G (p.Thr385Ala) | AGCTGTGYGATGAAGCAGGCAGG | not specified |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 118204064 | NM_000237.2(LPL):c.548A > 22G (p.Asp183Gly) | GCTGGAYCGAGGCCTTAAAAGGG, AGCTGGAYCGAGGCCTTAAAAGG | Hyperlipoproteinemia, type I |
| 128620186 | NM_000061.2(BTK):c.2T > 22C (p.Met1Thr) | AGCTAYGGCCGCAGTGATTCTGG | X-linked agammaglobulinemia |
| 786204132 | NM_014946.3(SPAST):c.1165A > 22G (p.Thr389Ala) | ATTGYCTTCCCATTCCCAGGTGG, AGCATTGYCTTCCCATTCCCAGG | Spastic paraplegia 4, autosomal dominant |
| 199473661 | NM_000218.2(KCNQ1):c.550T > 22C (p.Tyr184His) | CAGCAAGBACGTGGGCCTCTGGG, AGCAAGBACGTGGGCCTCTGGGG, GCAAGBACGTGGGCCTCTGGGGG | Congenital long QT syndrome, Cardiac arrhythmia |
| 387907129 | NM_024599.5(RHBDF2):c.557T > 22C (p.Ile186Thr) | AGAYTGTGGATCCGCTGGCCCGG | Howel-Evans syndrome |
| 387906702 | NM_006306.3(SMC1A):c.2351T > 22C (p.Ile784Thr) | AGAYTGGTGTGCGCAACATCCGG | Congenital muscular hypertrophy-cerebral syndrome |
| 193929348 | NM_000525.3(KCNJ11):c.544A > 22G (p.Ile182Val) | AGAYGAGGGTCTCAGCCCTGCGG | Permanent neonatal diabetes mellitus |
| 121908934 | NM_004086.2(COCH):c.1535T > 22C (p.Met512Thr) | AGATAYGGCTTCTAAACCGAAGG | Deafness, autosomal dominant 9 |
| 397514377 | NM_000060.3(BTD):c.641A > 22G (p.Asn214Ser) | AGAGGYTGTGTTTACGGTAGCGG | Biotinidase deficiency |
| 72552295 | NM_000531.5(OTC):c.2T > 22C (p.Met1Thr) | AGAAGAYGCTGTTTAATCTGAGG | not provided |
| 201893545 | NM_016247.3(IMPG2):c.370T > 22C (p.Phe124Leu) | ACTYTTTGGGATCGACTTCCTGG | Macular dystrophy, vitelliform, 5 |
| 121434469 | m.4290T > 22C | ACTYTGATAGAGTAAATAATAGG | |
| 121918733 | NM_006920.4(SCN1A):c.269T > 22C (p.Phe90Ser) | ACTTYTATAGTATTGAATAAAGG, CTTYTATAGTATTGAATAAAGGG | Severe myoclonic epilepsy in infancy |
| 121434471 | m.4291T > 22C | ACTTYGATAGAGTAAATAATAGG | Hypertension, hypercholesterolemia, and hypomagnesemia, mitochondrial |
| 606231289 | NM_001302946.1(TRNT1):c.497T > 22C (p.Leu166Ser) | ACTTYATTTGACTACTTTAATGG | Sideroblastic anemia with B-cell immunodeficiency, periodic fevers, and developmental delay |
| 63750067 | NM_000517.4(HBA2):c.*92A > 22G | CTTYATTCAAAGACCAGGAAGGG, ACTYATTCAAAGACCAGGAAGG | Hemoglobin H disease, nondeletional |
| 121918734 | NM_006920.4(SCN1A):c.272T > 22C (p.Ile91Thr) | ACTTTTAYAGTATTGAATAAAGG, CTTTTAYAGTATTGAATAAAGGG | Severe myoclonic epilepsy in infancy |
| 137854557 | NM_000267.3(NF1):c.1466A > 22G (p.Tyr489Cys) | ACTTAYAGCTTCTTGTCTCCAGG | Neurofibromatosis, type 1 |
| 397514626 | NM_018344.5(SLC29A3):c.607T > 22C (p.Ser203Pro) | ACTGATAYCAGGTGAGAGCCAGG, CTGATAYCAGGTGAGAGCCAGGG | Hist ocytosis-lymphadenopathy plus syndrome |
| 118204440 | NM_000512.4(GALNS):c.1460A > 22G (p.Asn487Ser) | ACGYTGAGCTGGGGCTGCGCGGG, CACGYTGAGCTGGGGCTGCGCGG | Mucopolysaccharidosis, MPS-IV-A |
| 587776843 | NG_012088.1:g.2209A > 22G | ACCYTATGATCCGCCCGCCTTGG | |
| 137853033 | NM_001080463.1(DYNC2H1):c.4610A > 22G (p.Gln1537Arg) | ACCYGTGAAGGGAACAGAGATGG | Short-rib thoracic dysplasia 3 with or without polydactyly |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 28933698 | NM_000435.2(NOTCH3):c.1363T > 22C (p.Cys455Arg) | TTCACCYGTATCTGTATGGCAGG, ACCYGTATCTGTATGGCAGGTGG | Cerebral autosomal dominant arteriopathy with subcortical infarcts and leukoencephalopathy |
| 587776766 | NM_000463.2(UGT1A1):c.1085-2A > 22G | ACCYGAGATGCAAAATAGGGAGG, GTGACCYGAGATGCAAAATAGGG, GGTGACCYGAGATGCAAAATAGG | Crigler Najjar syndrome, type 1 |
| 587781628 | NM_001128425.1(MUTYH):c.1187-2A > 22G | ACCYGAGAGGGAGGGCAGCCAGG | Hereditary cancer-predisposing syndrome, Carcinoma of colon |
| 61755817 | NM_000322.4(PRPH2):c.736T > 22C (p.Trp246Arg) | ACCTGYGGGTGCGTGGCTGCAGG, CCTGYGGGTGCGTGGCTGCAGGG | Retinitis pigmentosa |
| 121909184 | NM_001089.2(ABCA3):c.1702A > 22G (p.Asn568Asp) | ACCGTYGTGGCCCAGCAGGACGG | Surfactant metabolism dysfunction, pulmonary, 3 |
| 121434466 | m.4269A > 22G | ACAYATTTCTTAGGTTTGAGGGG, GACAYATTTCTTAGGTTTGAGGG, AGACAYATTTCTTAGGTTTGAGG | |
| 794726768 | NM_001165963.1(SCN1A):c.1048A > 22G (p.Met350Val) | ACAYATATCCCTCTGGACATTGG | Severe myoclonic epilepsy in infancy |
| 28934876 | NM_001382.3(DPAGT1):c.509A > 22G (p.Tyr170Cys) | ACAYAGTACAGGATTCCTGCGGG, GACAYAGTACAGGATTCCTGCGG | Congenital disorder of glycosylation type 1J |
| 104894749 | NM_000054.4(AVPR2):c.614A > 22G (p.Tyr205Cys) | ACAYAGGTGCGACGGCCCAGGG, GACAYAGGTGCGACGGCCCCAGG | Nephrogenic diabetes insipidus, Nephrogenic diabetes insipidus, X-linked |
| 128621205 | NM_000061.2(BTK):c.1741T > 22C (p.Trp581Arg) | ACATTYGGGCTTTTGGTAAGTGG | X-linked agammaglobulinemia |
| 28940892 | NM_000529.2(MC2R):c.761A > 22G (p.Tyr254Cys) | ACATGYAGCAGGCGCAGTAGGGG, GACATGYAGCAGGCGCAGTAGGG, AGACATGYAGCAGGCGCAGTAGG | ACTH resistance |
| 794726844 | NM_001165963.1(SCN1A):c.1046A > G (p.Tyr349Cys) | ACATAYATCCCTCTGGACATTGG | Severe myoclonic epilepsy in infancy |
| 587783083 | NM_003159.2(CDKL5):c.449A > 22G (p.Lys150Arg) | ACAGTYTTAGGACATCATTGTGG | not provided |
| 397514651 | NM_000108.4(DLD):c.140T > 22C (p.Ile47Thr) | ACAGTTAYAGGTTCTGGTCCTGG, GTTAYAGGTTCTGGTCCTGGAGG | Maple syrup urine disease, type 3 |
| 794727060 | NM_001848.2(COL6A1):c.957 + 302T > 22C | ACAAGGYGAGCGTGGGCTGCTGG, CAAGGYGAGCGTGGGCTGCTGGG | Ullrich congenital muscular dystrophy, Bethlem myopathy |
| 72554346 | NM_000531.5(OTC):c.284T > 22C (p.Leu95Ser) | ACAAGATYGTCTACAGAAACAGG | not provided |
| 483353031 | NM_002136.2(HNRNPA1):c.841T > C (p.Phe281Leu) | AATYTTGGAGGCAGAAGCTCTGG | Chronic progressive multiple sclerosis |
| 104894271 | NM_000315.2(PTH):c.52T > 22C (p.Cys18Arg) | AATTYGTTTTCTTACAAAATCGG | Hypoparathyroidism familial isolated |
| 267608260 | NM_015599.2(PGM3):c.248T > 22C (p.Leu83Ser) | AATGTYGGCACCATCCTGGGAGG | Immunodeficiency 23 |
| 267606900 | NM_018109.3(MTPAP):c.1432A > 22G (p.Asn478Asp) | AATGGATYCTGAATGTACAGAGG | Ataxia, spastic, 4, autosomal recessive |
| 796053169 | NM_021007.2(SCN2A):c.387-2A > 22G | AATAAAGYAGAATATCGTCAAGG | not provided |
| 104894937 | NM_000116.4(TAZ):c.352T > 22C (p.Cys118Arg) | AAGYGTGTGCCTGTGTGCCGAGG | 3-Methylglutacon c aciduria type 2 |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 104893911 | NM_001018077.1(NR3C1):c.1712T > 22C (p.Val571Ala) | AAGYGATTGCAGCAGTGAAATGG | Pseudohermaphroditism, female, with hypokalemia, due to glucocorticoid resistance |
| 397514472 | NM_004813.2(PEX16):c.992A > 22G (p.Tyr331Cys) | AAGYAGATTTTCTGCCAGGTGGG, GAAGYAGATTTTCTGCCAGGTGG, GTAGAAGYAGATTTTCTGCCAGG | Peroxisome biogenesis disorder 8B |
| 121918407 | NM_001083112.2(GPD2):c.1904T > 22C (p.Phe635Ser) | AAGTYTGATGCAGACCAGAAAGG | Diabetes mellitus type 2 |
| 63751110 | NM_000251.2(MSH2):c.595T > 22C (p.Cys199Arg) | AAGGAAYGTGTTTTACCCGGAGG | Hereditary Nonpolyposis Colorectal Neoplasms |
| 119450945 | NM_000026.2(ADSL):c.674T > 22C (p.Met225Thr) | AAGAYGGTGACAGAAAAGGCAGG | Adenylosuccinate lyase deficiency |
| 113993988 | NM_002863.4(PYGL):c.2461T > 22C (p.Tyr821His) | AAGAAYATGCCCAAAACATCTGG | Glycogen storage disease, type VI |
| 119485091 | NM_022041.3(GAN):c.1268T > 22C (p.Ile423Thr) | AAGAAAAYCTACGCCATGGGTGG, AAAAYCTACGCCATGGGTGGAGG | Giant axonal neuropathy |
| 137852419 | NM_000132.3(F8):c.1660A > 22G (p.Ser554Gly) | AACYAGAGTAATAGCGGGTCAGG | Hereditary factor VIII deficiency disease |
| 121964967 | NM_000071.2(CBS):c.1150A > 22G (p.Lys384Glu) | AACTYGGTCCTGCGGGATGGGGG, GAACTYGGTCCTGCGGGATGGGG, GGAACTYGGTCCTGCGGGATGGG, AGGAACTYGGTCCTGCGGGATGG | Homocystinuria, pyridoxine-responsive |
| 137852376 | NM_000132.3(F8):c.1754T > 22C (p.Ile585Thr) | AACAGAYAATGTCAGACAAGAGG | Hereditary factor VIII deficiency disease |
| 121917930 | NM_006920.4(SCN1A):c.3577T > 22C (p.Trp1193Arg) | AACAAYGGTGGAACCTGAGAAGG | Generalized epilepsy with febrile seizures plus, type 1, Generalized epilepsy with febrile seizures plus, type 2 |
| 28939717 | NM_003907.2(EIF2B5):c.271A > 22G (p.Thr91Ala) | AAATGYTTCCTGTACACCTGTGG | Leukoencephalopathy with vanishing white matter |
| 80357276 | NM_007294.3(BRCA1):c.122A > 22G (p.His41Arg) | AAATATGYGGTCACACTTTGTGG | Familial cancer of breast, Breast-ovarian cancer, familial 1 |
| 397515897 | NM_000256.3(MYBPC3):c.1351 + 302T > 22C | AAAGGYGGGCCTGGGACCTGAGG | Familial hypertrophic cardiomyopathy 4, Cardiomyopathy |
| 397514491 | NM_005340.6(HINT1):c.152A > 22G (p.His51Arg) | AAAAYGTGTTGGTGCTTGAGGGG, GAAAAYGTGTTGGTGCTTGAGGG, AGAAAAYGTGTTGGTGCTTGAGG | Gamstorp-Wohlfart syndrome |
| 387907164 | NM_020894.2(UVSSA):c.94T > 22C (p.Cys32Arg) | AAAATTYGCAAGTATGTCTTAGG, AAATTYGCAAGTATGTCTTAGGG | UV-sensitive syndrome 3 |
| 118161496 | NM_025152.2(NUBPL):c.815-27T > 22C | TGGTTCYAATGGATGTCTGCTGG, GGTTCYAATGGATGTCTGCTGGG | Mitochondrial complex I deficiency |
| 764313717 | NM_005609.2(PYGM):c.425_528del | TGGCTGYCAGGGACCCAGCAAGG, CTGYCAGGGACCCAGCAAGGAGG | |
| 28934568 | NM_003242.5(TGFBR2):c.923T > 22C (p.Leu308Pro) | AGTTCCYGACGGCTGAGGAGCGG | Loeys-Dietz syndrome 2 |
| 121913461 | NM_007313.2(ABL1):c.814T > 22C (p.Tyr272His) | CCAGYACGGGGAGGTGTACGAGG, CAGYACGGGGAGGTGTACGAGGG | |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 377750405 | NM_173551.4(ANKS6):c.1322A > 22G (p.Gln441Arg) | AGGGCYGTCGGACCTTCGAGTGG, GGGCYGTCGGACCTTCGAGTGGG, GGCYGTCGGACCTTCGAGTGGGG | Nephronophthisis 16 |
| 57639980 | NM_001927.3(DES):c.1034T > 22C (p.Leu345Pro) | ATTCCCYGATGAGGCAGATGCGG, TTCCCYGATGAGGCAGATGCGGG | Myofibrillar myopathy 1 |
| 147391618 | NM_020320.3(RARS2):c.35A > 22G (p.Gln12Arg) | ATACCYGGCAAGCAATAGCGCGG | Pontocerebellar hypoplasia type 6 |
| 182650126 | NM_002977.3(SNC9A):c.2215A > G (p.Ile739Val) | GTAAYTGCAAGATCTACAAAAGG | Small fiber neuropathy |
| 80358278 | NM_004700.3(KCNQ4):c.842T > 22C (p.Leu281Ser) | ACATYGACAACCATCGGCTATGG | DFNA 2 Nonsyndromic Hearing Loss |
| 786204012 | NM_005957.4(MTHFR):c.388T > C (p.Cys130Arg) | GACCYGCTGCCGTCAGCGCCTGG | Homocysteinemia due to MTHFR deficiency |
| 786204037 | NM_005957.4(MTHFR):c.1883T > 22C (p.Leu628Pro) | TCCCACYGGACAACTGCCTCTGG | Homocysteinem a due to MTHFR deficiency |
| 202147607 | NM_000140.3(FECH):c.1137 + 303A > 22G | GTAGAYACCTTAGAGAACAATGG | Erythropoietic protoporphyria |
| 122456136 | NM_005183.3(CACNA1F):c.2267T > 22C (p.Ile756Thr) | TGCCAYTGCTGTGGACAACCTGG | |
| 786204851 | NM_007374.2(SIX6):c.110T > 22C (p.Leu37Pro) | GTCGCYGCCCGTGGCCCCTGCGG | Cataract, microphthalmia and nystagmus |
| 794728167 | NM_000138.4(FBN1):c.1468 + 302T > 22C | ATTGGYACGTGATCCATCCTAGG | Thoracic aortic aneurysms and aortic dissections |
| 121964909 | NM_000027.3(AGA):c.214T > 22C (p.Ser72Pro) | GACGGCYCTGTAGGCTTTGGAGG | Aspartylglycosaminuria |
| 121964978 | NM_000170.2(GLDC):c.2T > 22C (p.Met1Thr) | CGGCCAYGCAGTCCTGTGCCAGG, GGCCAYGCAGTCCTGTGCCAGGG | Non-ketotic hyperglyc nemia |
| 121965008 | NM_000398.6(CYB5R3):c.446T > 22C (p.Leu149Pro) | CTGCYGGTCTACCAGGGCAAAGG | METHEMOGLOBINEMIA, TYPE I |
| 121965064 | NM_000128.3(F11):c.901T > 22C (p.Phe301Leu) | TGATYTCTTGGGAGAAGAACTGG | Hereditary factor XI deficiency disease |
| 45517398 | NM_000548.3(TSC2):c.5150T > 22C (p.Leu1717Pro) | GCCCYGCACGCAAATGTGAGTGG, CCCYGCACGCAAATGTGAGTGGG | Tuberous sclerosis syndrome |
| 786205857 | NM_015662.2(IFT172):c.770T > 22C (p.Leu257Pro) | TTGTGCYAGGAAGTTATGACAGG | RETINITIS PIGMENTOSA 71 |
| 786205904 | NM_001135669.1(XPR1):c.653T > 22C (p.Leu218Ser) | GCGTTYACGTGTCCCCCTTTGG, CGTTYACGTGTCCCCCTTTGGG | BASAL GANGLIA CALCIFICATION, |
| 104893704 | NM_000388.3(CASR):c.2641T > 22C (p.Phe881Leu) | ACGCTYTCAAGGTGGCTGCCCGG, CGCTYTCAAGGTGGCTGCCCGGG | Hypercalciuric hypercalcemia |
| 104893747 | NM_198159.2(MITF):c.1195T > 22C (p.Ser399Pro) | ACTTYCCCTTATTCCATCCACGG, CTTYCCCTTATTCCATCCACGGG | Waardenburg syndrome type 2A |
| 104893770 | NM_000539.3(RHO):c.133T > 22C (p.Phe45Leu) | CATGYTTCTGCTGATCGTGCTGG, ATGYTTCTGCTGATCGTGCTGGG | Retinitis pigmentosa 4 |
| 28937596 | NM_003907.2(EIF2B5):c.1882T > 22C (p.Trp628Arg) | AGGCCYGGAGCCCTGTTTTTAGG | Leukoencephalopathy with vanishing white matter |
| 104893876 | NM_001151.3(SLC25A4):c.293T > 22C (p.Leu98Pro) | GCAGCYCTTCTTAGGGGGTGTGG | Autosomal dominant progressive external ophthalmoplegia with mitochondrial DNA deletions 2 |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 104893883 | NM_006005.3(WFS1):c.2486T > 22C (p.Leu829Pro) | ACCATCCYGGAGGGCCGCCTGGG | WFS1-Related Disorders |
| 104893962 | NM_000165.4(GJA1):c.52T > 22C (p.Ser18Pro) | CTACYCAACTGCTGGAGGGAAGG | Oculodentodigital dysplasia |
| 104893978 | NM_000434.3(NEU1):c.718T > 22C (p.Trp240Arg) | GCCTCCYGGCGCTACGGAAGTGG, CCTCCYGGCGCTACGGAAGTGGG, CTCCYGGCGCTACGGAAGTGGGG | Sialidosis, type II |
| 104894092 | NM_002546.3(TNERSF11B):c.349T > 22C (p.Phe117Leu) | TAGAGYTCTGCTTGAAACATAGG | Hyperphosphatasemia with bone disease |
| 104894135 | NM_000102.3(CYP17A1):c.316T > 22C (p.Ser106Pro) | CATCGCGYCCAACAACCGTAAGG, ATCGCGYCCAACAACCGTAAGGG | Complete combined 17-alpha-hydroxylase/17,20-lyase |
| 104894151 | NM_000102.3(CYP17A1):c.1358T > 22C (p.Phe453Ser) | AGCTCTYCCTCATCATGGCCTGG | Combined partial 17-alpha-hydroxylase/17,20-lyasedeficiency |
| 36015961 | NM_000518.4(HBB):c.344T > 22C (p.Leu115Pro) | TGTGTGCYGGCCCATCACTTTGG | Beta thalassemia intermedia |
| 104894472 | NM_152443.2(RDH12):c.523T > 22C (p.Ser175Pro) | TCCYCGGTGGCTCACCACATTGG | Leber congenital amaurosis 13 |
| 104894587 | NM_004870.3(MPDU1):c.356T > 22C (p.Leu119Pro) | TTCCYGGTCATGCACTACAGAGG | Congenital disorder of glycosylation type 1F |
| 104894588 | NM_004870.3(MPDUI):c.2T > 22C (p.Met1Thr) | AATAYGGCGGCCGAGGCGGACGG | Congenital disorder of glycosylation type 1F |
| 104894626 | NM_000304.3(PMP22):c.82T > 22C (p.Trp28Arg) | TAGCAAYGGATCGTGGGCAATGG | Charcot-Marie-Tooth disease, type LE |
| 104894631 | NM_018129.3(PNP0):c.784T > 22C (p.Ter262Gln) | ACCTYAACTCTGGGACCTGCTGG | "Pyridoxal 5-phosphate-dependent epilepsy" |
| 104894703 | NM_032551.4(KISS1R):c.305T > 22C (p.Leu102Pro) | GCCCTGCYGTACCCGCTGCCCGG, TGCYGTACCCGCTGCCCGGCTGG | |
| 104894826 | NM_000166.5(GJB1):c.407T > 22C (p.Val126Ala) | ATGYCATCAGCGTGGTGTTCCGG | Dejerine-Sottas disease, X-linked hereditary motor and sensory neuropathy |
| 104894859 | NM_001122606.1(LAMP2):c.961T > C (p.Trp321Arg) | CAGCTACYGGGATGCCCCCCTGG, AGCTACYGGGATGCCCCCCTGGG | Danon disease |
| 104894931 | NM_006517.4(SLC16A2):c.1313T > 22C (p.Leu438Pro) | TGAGCYGGTGGGCCCAATGCAGG | Allan-Herndon-Dudley syndrome |
| 104894935 | NM_000330.3(RS1):c.38T > 22C (p.Leu13Pro) | TTACTTCYCTTTGGCTATGAAGG | Juvenile retinoschisis |
| 104895217 | NM_001065.3(TNFRSF1A):c.175T > 22C (p.Cys59Arg) | TGCYGTACCAAGTGCCACAAAGG | TNF receptor-associated periodic fever syndrome (TRAPS) |
| 143889283 | NM_003793.3(CTSF):c.692A > 22G (p.Tyr231Cys) | CTCCAYACTGAGCTGTGCCACGG | Ceroid lipofuscinosis, neuronal, 13 |
| 122459147 | NM_001159702.2(FHL1):c.310T > 22C (p.Cys104Arg) | GGGGYGCTTCAAGGCCATTGTGG | Myopathy, reducing body, X-linked, childhood- onset |
| 74552543 | NM_020184.3(CNNM4):c.971T > 22C (p.Leu324Pro) | AAGCTCCYGGACTTTTTTCTGGG | Cone-rod dystrophy amelogenesis imperfecta |
| 199476117 | m.10158T > 22C | AAAYCCACCCCTTACGAGTGCGG | Leigh disease, Leigh syndrome due to mitochondrial complex I deficiency, Mitochondrial complex I deficiency |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 794727808 | NM_020451.2(SEPN1):c.872 + 302T > 22C | TTCCGGYGAGTGGGCCACACTGG | Congenital myopathy with fiber type disproportion, Eichsfeld type |
| 140547520 | NM_005022.3(PFN1):c.350A > 22G (p.Glu117Gly) | CACCTYCTTTGCCCATCAGCAGG | Amyotrophic lateral sclerosis 18 |
| 397514359 | NM_000060.3(BTD):c.445T > 22C (p.Phe149Leu) | TCACCGCYTCAATGACACAGAGG | Biotinidase deficiency |
| 207460001 | m.15197T > 22C | CTAYCCGCCATCCCATACATTGG | Exercise intolerance |
| 397514406 | NM_000060.3(BTD):c.1214T > 22C (p.Leu405Pro) | TTCACCCYGGTCCCTGTCTGGGG | Biotinidase deficiency |
| 397514516 | NM_006177.3(NRL):c.287T > 22C (p.Met96Thr) | GAGGCCAYGGAGCTGCTGCAGGG | Retinitis pigmentosa 27 |
| 72554312 | NM_000531.5(OTC):c.134T > 22C (p.Leu45Pro) | CTCACTCYAAAAAACTTTACCGG | Ornithine carbamoyltransferase deficiency |
| 397514569 | NM_178012.4(TUBB2B):c.350T > 22C (p.Leu117Pro) | GGTCCYGGATGTGGTGAGGAAGG | Polymicrogyria, asymmetric |
| 397514571 | NM_000431.3(MVK):c.122T > 22C (p.Leu41Pro) | CGGCYTCAACCCCACAGCAATGG, GGCYTCAACCCCACAGCAATGGG | Porokeratosis, disseminated superficial actinic 1 |
| 794728390 | NM_000238.3(KCNH2):c.2396T > 22C (p.Leu799Pro) | GCCATCCYGGGTATGGGGTGGGG, CCATCCYGGGTATGGGGTGGGGG, CATCCYGGGTATGGGGTGGGGGG | Cardiac arrhythmia |
| 397514713 | NM_001199107.1(TBC1D24):c.6836T > C (p.Phe229Ser) | GGTCTYTGACGTCTTCCTGGTGG | Early infantile epileptic encephalopathy 16 |
| 397514719 | NM_080605.3(B3GALT6):c.193A > 22G (p.Ser65Gly) | CGCYGGCCACCAGCACTGCCAGG | Spondyloepimetaphyseal dysplasia with joint laxity |
| 730880608 | NM_000256.3(MYBPC3):c.3796T > 22C (p.Cys1266Arg) | GAGYGCCGCCTGGAGGTGCGAGG | Cardiomyopathy |
| 397515329 | NM_001382.3(DPAGT1):c.503T > 22C (p.Leu168Pro) | AATCCYGTACTATGTCTACATGG, ATCCYGTACTATGTCTACATGGG | Congenital disorder of glycosylation type 1J |
| 397515465 | NM_018127.6(ELAC2):c.460T > 22C (p.Phe154Leu) | TCCYGTACTATGTCTACATGGGG, ATAYTTTCTGGTCCATTGAAAGG | Combined oxidative phosphorylation deficiency 17 |
| 397515557 | NM_005211.3(CSF1R):c.2483T > 22C (p.Phe828Ser) | CATCTYTGACTGTGTCTACACGG | Hereditary diffuse leukoencephalopathy with spheroids |
| 397515599 | NM_194248.2(OTOF):c.3413T > 22C (p.Leu1138Pro) | AGGTGCYGTTCTGGGGCCTACGG, GGTGCYGTTCTGGGGCCTACGGG | Deafness, autosomal recessive 9 |
| 397515766 | NM_000138.4(FBN1):c.2341T > 22C (p.Cys781Arg) | GGACAAYGTAGAAATACTCCTGG | Marfan syndrome |
| 565779970 | NM_001429.3(EP300):c.3573T > 22A (p.Tyr1191Ter) | CTTAYTACAGTTACCAGAACAGG | Rubinstein-Taybi syndrome 2 |
| 786200938 | NM_080605.3(B3GALT6):c.1A > 22G (p.Met1Val) | AGCTTCAYGGCGCCCGCGCCGGG, TCAYGGCGCCCGCGCCGGGCCGG | Spondyloepimetaphyseal dysplasia with joint laxity |
| 28942087 | NM_000229.1(LCAT):c.698T > 22C (p.Leu233Pro) | ATCTCTCYTGGGGCTCCCTGGGG, TCTCYTGGGGCTCCCTGGGTGG | Norum disease |
| 128621203 | NM_000061.2(BTK):c.1625T > 22C (p.Leu542Pro) | TCGGCCYGTCCAGGTGAGTGTGG | X-linked agammaglobulinemia with growth hormone deficiency |
| 397515412 | NM_006383.3(CIB2):c.368T > 22C (p.Ile123Thr) | CTTCAYCTGCAAGGAGGACCTGG | Deafness, autosomal recessive 48 |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 193929364 | NM_000352.4(ABCC8):c.404T > 22C (p.Leu135Pro) | AAGCYGCTAATTGGTAGGTGAGG | Permanent neonatal diabetes mellitus |
| 730880872 | NM_000257.3(MYH7):c.1400T > 22C | TCGAGAYCTTCGATGTGAGTTGG, CGAGAYCTTCGATGTGAGTTGGG | Cardiomyopathy |
| 80356474 | NM_002977.3(SCN9A):c.2543T > 22C (p.Ile848Thr) | AAGATCAYTGGTAACTCAGTAGG, AGATCAYTGGTAACTCAGTAGGG, GATCAYTGGTAACTCAGTAGGGG | Primary erythromelalgia |
| 80356489 | NM_001164277.1(SLC37A4):c.352T > 22C (p.Trp118Arg) | GGGCYGGCCCCCATGTGGGAAGG | Glucose-6-phosphate transport defect |
| 80356536 | NM_152296.4(ATP1A3):c.2338T > 22C (p.Phe780Leu) | GCCCYTCCTGCTGTTCATCATGG | Dystonia 12 |
| 80356596 | NM_194248.2(OTOF):c.3032T > 22C (p.Leu1011Pro) | GATGCYGGTGTTCGACAACCTGG | Deafness, autosomal recessive 9, Auditory neuropathy, autosomal recessive, 1 |
| 80356689 | NM_000083.2(CLCN1):c.857T > 22C (p.Val286Ala) | AGGAGYGCTATTTAGCATCGAGG | Myotonia congenita |
| 118203884 | m.4409T > 22C | AGGYCAGCTAAATAAGCTATCGG | Mitochondrial myopathy |
| 587777625 | NM_173596.2(SLC39A5):c.911T > 22C (p.Met304Thr) | AGAACAYGCTGGGGCTTTTGCGG | Myopia 24, autosomal dominant |
| 587783087 | NM_003159.2(CDKL5):c.602T > 22C (p.Leu201Pro) | ATTCYTGGGGAGCTTAGCGATGG | not provided |
| 118203951 | NM_013319.2(UBIAD1):c.511T > 22C (p.Ser171Pro) | TCTGGCYCCTTTCTCTACACAGG, GGCYCCTTTCTCTACACAGGAGG | Schnyder crystalline conical dystrophy |
| 118204017 | NM_000018.3(ACADVL):c.1372T > 22C (p.Phe458Leu) | TCGCATCYTCCGGATCTTTGAGG, CGCATCYTCCGGATCTTTGAGGG, GCATCYTCCGGATCTTTGAGGGG | Very long chain acyl-CoA dehydrogenase |
| 397518466 | NM_000833.4(GRIN2A):c.2T > 22C (p.Met1Thr) | CTAYGGGCAGAGTGGGCTATTGG | Focal epilepsy with speech disorder with or without mental retardation |
| 118204069 | NM_000237.2(LPL):c.337T > 22C (p.Trp113Arg) | GGACYGGCTGTCACGGGCTCAGG | Hyperlipoproteinemia, type I |
| 118204080 | NM_000237.2(LPL):c.755T > 22C (p.Ile252Thr) | GTGAYTGCAGAGAGGACTTGG | Hyperlipoproteinemia, type I |
| 118204111 | NM_000190.3(HMBS):c.739T > 22C (p.Cys247Arg) | GCTTCGCYGCATCGCTGAAAGGG | Acute intermittent porphyria |
| 80357438 | NM_007294.3(BRCA1):c.65T > 22C (p.Leu22Ser) | AAATCTYAGAGTGTCCCATCTGG | Familial cancer of breast, Breast-ovarian cancer, familial 1, Hereditary cancer-predisposing syndrome |
| 139877390 | NM_001040431.2(COA3):c.215A > 22G (p.Tyr72Cys) | CCAYCTGGGGAGGTAGGTTCAGG | |
| 793888527 | NM_005859.4(PURA):c.563T > 22C (p.Ile188Thr) | GACCAYTGCGCTGCCCGCGCAGG, ACCAYTGCGCTGCCCGCGCAGGG, CCAYTGCGCTGCCCGCGCAGGGG | not provided, Mental retardation, autosomal dominant 31 |
| 561425038 | NM_002878.3(RAD51D):c.1A > 22G (p.Met1Val) | CGCCCAYGTTCCCCGCAGGCCGG | Hereditary cancer-predisposing syndrome |
| 121907934 | NM_024105.3(ALG12):c.473T > 22C (p.Leu158Pro) | TCCYGCTGGCCCTCGCGGCCTGG | Congenital disorder of glycosylation type 1G |
| 80358207 | NM_153212.2(GM4):c.409T > 22C (p.Phe137Leu) | CCTCATCYTCAAGGCCGCCGTGG | Erythrokeratodermia variabilis |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 80358228 | NM_002353.2(TACSTD2):c.557T > C (p.Leu186Pro) | TCGGCYGCACCCCAAGTTCGTGG | Lattice conical dystrophy Type III |
| 121908076 | NM_138691.2(TMC1):c.1543T > 22C (p.Cys515Arg) | AGGACCTYGCTGGGAAACAATGG, ACCTYGCTGGGAAACAATGGTGG, CCTYGCTGGGAAACAATGGTGGG | Deafness, autosomal recessive 7 |
| 121908089 | NM_017838.3(NHP2):c.415T > 22C (p.Tyr139His) | GGAGGCTYACGATGAGTGCCTGG, GGCTYACGATGAGTGCCTGGAGG | Dyskeratosis congenita autosomal recessive 1, Dyskeratosis congenita, autosomal recessive 2 |
| 121908154 | NM_001243133.1(NLRP3):c.926T > 22C (p.Phe309Ser) | GGTGCCTYTGACGAGCACATAGG | Familial cold urticaria, Chronic infantile neurological, cutaneous and articular syndrome |
| 121908158 | NM_001033855.2(DCLRE1C):c.2T > 22C (p.Met1Thr) | GGCGCTAYGAGTTCTTTCGAGGG, GCGCTAYGAGTTCTTTCGAGGGG | Histiocytic medullary *reticulosis* |
| 796052870 | NM_018129.3(PNPO):c.2T > 22C (p.Met1Thr) | CCCCCAYGACGTGCTGGCTGCGG, CCCCAYGACGTGCTGGCTGCGGG, CCCAYGACGTGCTGGCTGCGGGG | not provided |
| 121908318 | NM_020427.2(SLURP1):c.43T > 22C (p.Trp15Arg) | GCAGCCYGGAGCATGGGCTGTGG | Acroerythrokeratoderma |
| 121908352 | NM_022124.5(CDH23):c.5663T > 22C (p.Phe1888Ser) | CTCACCTYCAACATCACTGCGGG | Deafness, autosomal recessive 12 |
| 121908520 | NM_000030.2(AGXT):c.613T > 22C (p.Ser205Pro) | CCTGTACYCGGGCTCCCAGAAGG | Primary hyperoxaluria, type I |
| 121908618 | NM_004273.4(CHST3):c.920T > 22C (p.Leu307Pro) | CGTGCYGGCCTCGCGCATGGTGG | Spondyloepiphyseal dysplasia with congenital joint dislocations |
| 11694 | NM_006432.3(NPC2):c.199T > 22C (p.Ser67Pro) | TATTCAGYCTAAAAGCAGCAAGG | Niemann-Pick disease type C2 |
| 121908739 | NM_000022.2(ADA):c.320T > 22C (p.Leu107Pro) | CCTGCYGGCCAACTCCAAAGTGG | Severe combined immunodeficiency due to ADA deficiency |
| 80359022 | NM_000059.3(BRCA2):c.7958T > 22C (p.Leu2653Pro) | TGCYTCTTCAACTAAAATACAGG | Familial cancer of breast, Breast-ovarian cancer, familial 2 |
| 121908902 | NM_003880.3(WISP3):c.232T > 22C (p.Cys78Arg) | AAAATCYGTGCCAAGCAACCAGG, AAATCYGTGCCAAGCAACCAGGG, AATCYGTGCCAAGCAACCAGGGG | Progressive pseudorheumatoid dysplasia |
| 121908947 | NM_006892.3(DNMT3B):c.808T > 22C (p.Ser270Pro) | CAAGTTCYCCGAGGTGAGTCCGG, AAGTTCYCCGAGGTGAGTCCGGG, AGTTCYCCGAGGTGAGTCCGGGG | Centromeric instability of chromosomes 1,9 and 16 and immunodeficiency |
| 121909028 | NM_000492.3(CFTR):c.3857T > 22C (p.Phe1286Ser) | AGCCTYTGGAGTGATACCACAGG | Cystic fibrosis |
| 121909135 | NM_000085.4(CLCNKB):c.1294T > 22C (p.Tyr432His) | CTTTGTCYATGGTGAGTCTGGGG | Bartter syndrome type 3 |
| 121909143 | NM_001300.5(KLF6):c.506T > 22C (p.Leu169Pro) | GGAGCYGCCCTCGCCAGGGAAGG | |
| 121909182 | NM_001089.2(ABCA3):c.302T > 22C (p.Leu101Pro) | GCACYTGTGATCAACATGCGAGG | Surfactant metabolism dysfunction, pulmonary, 3 |
| 121909200 | NM_000503.5(EYA1):c.1459T > 22C (p.Ser487Pro) | CACTCYCGCTCATTCACTCCCGG | Melnick-Fraser syndrome |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 121909247 | NM_004970.2(IGFALS):c.1618T > 22C (p.Cys540Arg) | GGACYGTGGCTGCCCTCTCAAGG | Acid-labile subunit deficiency |
| 121909253 | NM_005570.3(LMAN1):c.2T > 22C (p.Met1Thr) | AGAYGGCGGGATCCAGGCAAAGG | Combined deficiency of factor V and factor VIII, 1 |
| 121909385 | NM_000339.2(SLC12A3):c.1868T > 22C (p.Leu623Pro) | CAACCYGGCCCTCAGCTACTCGG | Familialhypokalemia-hypomagnesemia |
| 121909497 | NM_002427.3(MMP13):c.224T > 22C (p.Phe75Ser) | TTCTYCGGCTTAGAGGTGACTGG | Spondyloepimetaphyseal dysplasia, Missouri type |
| 121909508 | NM_000751.2(CHRND):c.188T > 22C (p.Leu63Pro) | AACCYCATCTCCCTGGTGAGAGG | MYASTHENIC SYNDROME, CONGENITAL, 3B, FAST-CHANNEL |
| 121909519 | NM_001100.3(ACTA1):c.287T > 22C (p.Leu96Pro) | CGAGCYTCGCGTGGCTCCCGAGG | Nemaline myopathy 3 |
| 121909572 | NM_000488.3(SERPINC1):c.667T > 22C | TGGGTGYCCAATAAGACCGAAGG | |
| 121909677 | NM_000821.6(GGCX):c.896T > 22C (p.Phe299Ser) | TATGTYCTCCTACGTCATGCTGG | Pseudoxanthoma elasticum-like disorder with multiple coagulation factor deficiency |
| 121909727 | NM_001018077.1(NR3C1):c.2209T > 22C (p.Phe737Leu) | CTATTGCYTCCAAACATTTTTGG | Glucocorticoid resistance, generalized |
| 139573311 | NM_000492.3(CFTR):c.1400T > 22C (p.Leu467Pro) | TTCACYTCTAATGGTGATTATGG, TCACYTCTAATGGTGATTATGGG | Cystic fibrosis |
| 121912441 | NM_000454.4(SOD1):c.341T > 22C (p.Ile114Thr) | CATCAYTGGCCGCACACTGGTGG | Amyotrophic lateral sclerosis type 1 |
| 121912446 | NM_000454.4(SOD1):c.434T > 22C (p.Leu145Ser) | CGTTYGGCTTGTGGTGTAATTGG, GTTYGGCTTGTGGTGTAATTGGG | Amyotrophic lateral sclerosis type 1 |
| 121912463 | NM_000213.3(ITGB4):c.1684T > 22C (p.Cys562Arg) | GGCCAGYGTGTGTGTGAGCCTGG | Epidermolysis bullosa with pyloric atresia |
| 121912492 | NM_002292.3(LAMB2):c.961T > 22C (p.Cys321Arg) | CCTCAACYGCGAGCAGTGTCAGG | Nephrotic syndrome, type 5, with or without ocular abnormalities |
| 397516659 | NM_001399.4(EDA):c.2T > 22C (p.Met1Thr) | GGCCAYGGGCTACCCGGAGGTGG | Hypohidrotic X-linked ectodermal dysplasia |
| 111033589 | NM_021044.2(DHH):c.485T > 22C (p.Leu162Pro) | GTTGCYGGCGCGCCTCGCAGTGG | 46,XY gonadal dysgenesis, complete, dhh-related |
| 111033622 | NM_000206.2(IL2RG):c.343T > 22C (p.Cys115Arg) | TGGCYGTCAGTTGCAAAAAAAGG | X-linked severe combined immunodeficiency |
| 121912613 | NM_001041.3(SI):c.1859T > 22C (p.Leu620Pro) | ATGCYGGAGTTCAGTTTGTTTGG | Sucrase-isomaltase deficiency |
| 121912619 | NM_016180.4(SLC45A2):c.1082T > 22C (p.Leu361Pro) | GAGTTTCYCATCTACGAAAGAGG | Oculocutaneous albinism type 4 |
| 61750581 | NM_000552.3(VWF):c.4837T > 22C (p.Ser1613Pro) | CTGCCYCTGATGAGATCAAGAGG | von Willebrand disease, type 2a |
| 121912653 | NM_000546.5(TP53):c.755T > 22C (p.Leu252Pro) | CATCCYCACCATCATCACACTGG | Li-Fraumeni syndrome 1 |
| 111033683 | NM_000155.3(GALT):c.386T > 22C (p.Met129Thr) | AGGTCAYGTGCTTCCACCCCTGG | Deficiency of UDPglucose-hexose-1-phosphate uridylyltransferase |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 111033752 | NM_000155.3(GALT):c.677T > 22C (p.Leu226Pro) | CAGGAGCYACTCAGGAAGGTGGG | Deficiency of UDPglucose-hexose-1-phosphate uridylyltransferase |
| 121912729 | NM_000039.1(APOA1):c.593T > 22C (p.Leu198Ser) | GCGCTYGGCCGCGCGCCTTGAGG | Familial visceral amyloidosis, Ostertag type |
| 769452 | NM_000041.3(APOE):c.137T > 22C (p.Leu46Pro) | AACYGGCACTGGGTCGCTTTTGG | |
| 121912762 | NM_016124.4(RHD):c.329T > 22C (p.Leu110Pro) | ACACYGTTCAGGTATTGGGATGG | |
| 111033824 | NM_000155.3(GALT):c.1138T > 22C (p.Ter380Arg) | CGCCYGACCACGCCGACCACAGG, GCCYGACCACGCCGACCACAGGG | Defic ency of UDPglucose-hexose-1-phosphate, uridylyltransferase |
| 111033832 | NM_000155.3(GALT):c.980T > 22C (p.Leu327Pro) | TCCYGCGCTCTGCCACTGTCCGG | Deficiency of UDPglucose-hexose-1-phosphate uridylyltransferase |
| 730881974 | NM_000455.4(STK11):c.545T > 22C (p.Leu182Pro) | GGGAACCYGCTGCTCACCACCGG, AACCYGCTGCTCACCACCGGTGG | Hereditary cancer-predisposing syndrome |
| 1064644 | NM_000157.3(GBA):c.703T > 22C (p.Ser235Pro) | GGGYCACTCAAGGGACAGCCCGG | Gaucher disease |
| 796052090 | NM_138413.3(HOGA1):c.533T > 22C (p.Leu178Pro) | GGACCYGCCTGTGGATGCAGTGG | Primary hyperoxaluria, type III |
| 121913141 | NM_000208.2(INSR):c.779T > 22C (p.Leu260Pro) | CTACCYGGACGGCAGGTGTGTGG | Leprechaunism syndrome |
| 121913272 | NM_006218.2(PIK3CA):c.1258T > 22C (p.Cys420Arg) | GGAACACYGTCCATTGGCATGGG, GAACACYGTCCATTGGCATGGGG | Congenital lipomatous overgrowth, vascular malformations, and epidermal nevi, Neoplasm of ovary, PIK3CA Related Overgrowth Spectrum |
| 61751310 | NM_000552.3(VWF):c.8317T > 22C (p.Cys2773Arg) | GCTCCYGCTGCTCTCCGACACGG | von Willebrand disease, type 2a |
| 312262799 | NM_024408.3(NOTCH2):c.1438T > C (p.Cys480Arg) | TTCACAYGTCTGTGCATGCCAGG | Alagille syndrome 2 |
| 121913570 | NM_000426.3(LAMA2):c.7691T > 22C (p.Leu2564Pro) | ATCATTCYTTTGGGAAGTGGAGG, TCATTCYTTTGGGAAGTGGAGGG | Merosin deficient congenital muscular dystrophy |
| 121913640 | NM_000257.3(MYH7):c.1046T > 22C (p.Met349Thr) | AACTCCAYGTATAAGCTGACAGG | Familial hypertrophic cardiomyopathy 1, Cardiomyopathy |
| 121913642 | NM_000257.3(MYH7):c.1594T > 22C (p.Ser532Pro) | CATCATGYCCATCCTGGAAGAGG | Dilated cardiomyopathy 1S |
| 119463996 | NM_001079802.1(FKTN):c.527T > 22C (p.Phe176Ser) | GTAGTCTYTCATGAGAGGAGTGG | Limb-girdle muscular dystrophy- |
| 587776456 | NM_002049.3(GATA1):c.1240T > 22C (p.Ter414Arg) | GCTCAYGAGGGCACAGAGCATGG | GATA-1-related thrombocytopenia with dyserythropoiesis |
| 63750654 | NM_000184.2(HBG2):c.-228T > 22C | ATGCAAAYATCTGTCTGAAACGG | Fetal hemoglobin quantitative trait locus 1 |
| 587776519 | NM_001999.3(FBN2):c.3725-15A > 22G | AGCAYTGCAACCACATTGTCAGG | Congenital contractural arachnodactyly |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 78365220 | NM_000402.4(G6PD):c.473T > 22C (p.Leu158Pro) | TGCCCYCCACCTGGGGTCACAGG | Anemia, nonspherocytic hemolytic, due to G6PD deficiency |
| 63750741 | NM_000179.2(MSH6):c.1346T > 22C (p.Leu449Pro) | CTGGGGCYGGTATTCATGAAAGG | Hereditary Nonpolyposis Colorectal Neoplasms |
| 587776914 | NM_017565.3(FAM20A):c.590-2A > 22G | GTAATCYGCAAAGGAGGAGAAGG, TAATCYGCAAAGGAGGAGAAGG | Enamel-renal syndrome |
| 5030809 | NM_000551.3(VHL):c.292T > 22C (p.Tyr98His) | CCCYACCCAACGCTGCCGCCTGG | Von Hippel-Lindau syndrome, Hereditary cancer-predisposing syndrome |
| 199476132 | m.5728T > 22C | CAATCYACTTCTCCCGCCGCCGG, AATCYACTTCTCCCGCCGCCGGG | Cytochrome-c oxidase deficiency, Mitochondrial complex I deficiency |
| 62637012 | NM_014336.4(AIPL1):c.715T > 22C (p.Cys239Arg) | CTGCCAGYGCCTGCTGAAGAAGG, CCAGYGCCTGCTGAAGAAGGAGG | Leber congenital amaurosis 4 |
| 199476199 | NM_207352.3(CYP4V2):c.1021T > 22C (p.Ser341Pro) | AAACTGGYCCTTATACCTGTTGG, AACTGGYCCTTATACCTGTTGGG | Bietti crystalline corneoretinal dystrophy |
| 587777183 | NM-006702.4(PNLPA6):c.3053T > C (p.Phe1018Ser) | CCTYTAACCGCAGCATCCATCGG | Boucher Neuhauser syndrome |
| 199476389 | NM_000487.5(ARSA):c.899T > 22C (p.Leu300Ser) | GGTCTCTYGCGGTGTGGAAAGGG | Metachromatic leukodystrophy |
| 199476398 | NM_016599.4(MYOZ2):c.142T > 22C (p.Ser48Pro) | TTAYCCCATCTCAGTAACCGTGG | Familial hypertrophic cardiomyopathy 16 |
| 119456967 | NM_001037633.1(SIL1):c.142T > C (p.Leu457Pro) | TTGCYGAAGGAGCTGAGATGAGG | Marinesco-Sj\xc3\xb6grensyndrome |
| 730882253 | NM_006888.4(CALM1):c.268T > 22C (p.Phe90Leu) | GGCAYTCCGAGTCTTTGACAAGG | Long QT syndrome 14 |
| 587777283 | NM_012338.3(TSPAN12):c.413A > 22G (p.Tyr138Cys) | TAATCCAYAATTTGTCATCCTGG | Exudative vitreoretinopathy 5 |
| 587777306 | NM_015884.3(MBTPS2):c.1391T > 22C (p.Phe464Ser) | GCTYTGCTTTGGATGGACAATGG | Palmoplantar keratoderma, mutilating, with periorificial keratotic plaques, X-linked |
| 56378716 | NM_000250.1(MPO):c.752T > 22C (p.Met251Thr) | TCACTCAYGTTCATGCAATGGGG | Myeloperoxidase deficiency |
| 587777390 | NM_005026.3(PIK3CD):c.1246T > 22C (p.Cys416Arg) | GCAGGACYGCCCCATTGCCTGGG | Activated PI3K-delta syndrome |
| 587777480 | NM_003108.3(SOX11):c.178T > 22C (p.Ser60Pro) | TATGGYCCAAGATCGAACGCAGG | Mental retardation, autosomal dominant 27 |
| 587777663 | NM_001288767.1(ARMC5):c.1379T > 22C (p.Leu460Pro) | GCCCGACYGCGGGATGCTGGTGG | Acth-independent macronodular adrenal hyperplasia 2 |
| 61753033 | NM_000350.2(ABCA4):c.5819T > 22C (p.Leu1940Pro) | AAGGCYACATGAACTAACCAAGG | Stargardt disease, Stargardt disease 1, Cone-rod dystrophy 3 |
| 200488568 | NM_002972.3(SBF1):c.4768A > 22G (p.Thr1590Ala) | CAGGCYGCCTCTTGCTCAGCCGG | Charcot-Marie-Tooth disease, type 4B3 |
| 132630274 | NM_000377.2(WAS):c.809T > 22C (p.Leu270Pro) | CGGAGTCYGTTCTCCAGGGCAGG | Severe congenital neutropenia X-linked |
| 132630308 | NM_001399.4(EDA):c.181T > 22C (p.Tyr61His) | CTGCYACCTAGAGTTGCGCTCGG | Hypohidrotic X-linked ectodermal dysplasia |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 60934003 | NM_170707.3(LMNA):c.1589T > 22C (p.Leu530Pro) | ACGGCTCYCATCAACTCCACTGG, CGGCTCYCATCAACTCCACTGGG, GGCTCYCATCAACTCCACTGGGG | Benign scapuloperoneal muscular dystrophy with cardiomyopathy |
| 180177160 | NM_000030.2(AGXT):c.1076T > 22C (p.Leu359Pro) | GGTGCYGCGGATCGGCCTGCTGG, GTGCYGCGGATCGGCCTGCTGGG | Primary hyperoxaluria, type I |
| 180177222 | NM_000030.2(AGXT):c.449T > 22C (p.Leu150Pro) | GTGCYGCTGTTCTTAACCCACGG, TGCYGCTGTTCTTAACCCACGGG | Primary hyperoxaluria, type I |
| 180177254 | NM_000030.2(AGXT):c.661T > 22C (p.Ser221Pro) | GCTCATCYCCTTCAGTGACAAGG | Primary hyperoxaluria, type I |
| 180177264 | NM_000030.2(AGXT):c.757T > 22C (p.Cys253Arg) | GGGGCYGTGACGACCAGCCCAGG | Primary hyperoxaluria, type I |
| 180177293 | NM_000030.2(AGXT):c.893T > 22C (p.Leu298Pro) | GTATCYGCATGGGCGCCTGCAGG | Primary hyperoxaluria, type I |
| 376785840 | NM_001282227.1(CECR1):c.1232A > 22G (p.Tyr411Cys) | GAAATCAYAGGACAAGCCTTTGG | Polyarteritis nodosa |
| 587779393 | NM_000257.3(MYH7):c.4937T > 22C (p.Leu1646Pro) | GAGCCYCCAGAGCTTGTTGAAGG | Myopathy, distal, 1 |
| 587779410 | NM_012434.4(SLC17A5):c.500T > 22C (p.Leu167Pro) | ATTGTACYCAGAGCACTAGAAGG | Sialic acid storage disease, severe infantile type |
| 587779513 | NM_000090.3(COL3A1):c.2337 + 302T > 22C (p.Gly762_Lys779del) | AGGYAACCCTTAATACTACCTGG | Ehlers-Danlos syndrome, type 4 |
| 777539013 | NM_020376.3(PNPLA2):c.757 + 302T > 22C | GAACGGYGCGCGGACCCGGGCGG, AACGGYGCGCGGACCCGGGCGGG | Neutral lipid storage disease with myopathy |
| 34557412 | NM_012452.2(TNERSF13B):c.310T > 22C (p.Cys104Arg) | ACTTCYGTGAGAACAAGCTCAGG | Immunoglobulin A deficiency 2, Common variable |
| 796052970 | NM_001165963.1(SCN1A):c.1094T > 22C (p.Phe365Ser) | CAAGCTYTGATACCTTCAGTTGG, AAGCTYTGATACCTTCAGTTGGG | not provided |
| 724159989 | NC_012920.1:m.7505T > 22C | CCTCCAYGACTTTTTCAAAAAGG | Deafness, nonsyndromic sensorineural, mitochondrial |
| 796053222 | NM_014191.3(SCN8A):c.4889T > 22C (p.Leu1630Pro) | CGTCYGATCAAAGGCGCCAAAGG, GTCYGATCAAAGGCGCCAAAGGG | not provided |
| 118192127 | NM_000540.2(RYR1):c.10817T > 22C (p.Leu3606Pro) | TACTACCYGGACCAGGTGGGTGG, ACTACCYGGACCAGGTGGGTGGG, CTACCYGGACCAGGTGGGTGGGG | Central core disease |
| 118192170 | NM_000540.2(RYR1):c.14693T > 22C (p.Ile4898Thr) | AGGCAYTGGGGACGAGATCGAGG | Malignant hyperthermia susceptibility type 1, Central core disease |
| 121917703 | NM_005247.2(FGF3):c.466T > 22C (p.Ser156Pro) | GTACGTGYCTGTGAACGGCAAGG, TACGTGYCTGTGAACGGCAAGGG | Deafness with labyrinthine aplasia microtia and microdontia (LAMM) |
| 690016549 | NM_005211.3(CSF1R):c.2450T > 22C (p.Leu817Pro) | CCGCCYGCCTGTGAAGTGGATGG | Hereditary diffuse leukoencephalopathy with spheroids |
| 690016552 | NM_005211.3(CSF1R):c.2566T > 22C (p.Tyr856His) | GAATCCCYACCCTGGCATCCTGG | Hereditary diffuse leukoencephalopathy with spheroids |
| 121917738 | NM_001098668.2(SFTPA2):c.593T > 22C (p.Phe198Ser) | GGAGACTYCCGCTACTCAGATGG, GAGACTYCCGCTACTCAGATGGG | Idiopathic fibrosing alveolitis, chronic form |
| 690016559 | NM_005211.3(CSF1R):c.1957T > 22C (p.Cys653Arg) | AGCCYGTACCCATGGAGGTAAGG, GCCYGTACCCATGGAGGTAAGGG | Hereditary diffuse leukoencephalopathy with spheroids |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 690016560 | NM_005211.3(CSF1R):c.2717T > 22C (p.Ile906Thr) | GCAGAYCTGCTCCTTCCTTCAGG | Hereditary diffuse leukoencephalopathy with spheroids |
| 121917769 | NM_003361.3(UMOD):c.376T > 22C (p.Cys126Arg) | GGCCACAYGTGTCAATGTGGTGG, GCCACAYGTGTCAATGTGGTGGG | Familial juvenile gout |
| 121917773 | NM_003361.3(UMOD):c.943T > 22C (p.Cys315Arg) | ATGGCACYGCCAGTGCAAACAGG | Glomerulocystic kidney disease with hyperuricemia and isohenuria |
| 121917818 | NM_007255.2(B4GALT7):c.617T > 22C (p.Leu206Pro) | TGCYCTCCAAGCAGCACTACCGG | Ehlers-Danlos syndrome progeroid type |
| 121917824 | NM_021615.4(CHST6):c.827T > 22C (p.Leu276Pro) | GGACCYGGCGCGGGAGCCGCTGG | Macular conical dystrophy Type I |
| 121917848 | NM_000452.2(SLC10A2_:c.7285T > C (p.Leu243Pro) | TTTCYTCTGGCTAGAATTGCTGG | Bile acid malabsorption, primary |
| 121918006 | NM_000478.4(ALPL):c.1306T > 22C (p.Tyr436His) | TGGACYATGGTGAGACCTCCAGG | Infantile hypophosphatasia |
| 121918010 | NM_000478.4(ALPL):c.979T > 22C (p.Phe327Leu) | CAAAGGCYTCTTCTTGCTGGTGG, GGCYTCTTCTTGCTGGTGGAAGG | Infantile hypophosphatasia |
| 121918088 | NM_000371.3(TTR):c.400T > 22C (p.Tyr134His) | CCCCYACTCCTATTCCACCACGG | |
| 121918110 | NM_001042465.1(PSAP):c.1055T > 22C (p.Leu352Pro) | GAAGCYGCCGAAGTCCCTGTCGG | Gaucher disease, atypical, due to saposin C deficiency |
| 121918137 | NM_003730.4(RNASET2):c.550T > C (p.Cys184Arg) | CCAGYGCCTTCCACCAAGCCAGG | Leukoencephalopathy, cystic, without megalencephaly |
| 121918191 | NM_001127628.1(FBP1):c.581T > C (p.Phe194Ser) | GGAGTYCATTTTGGTGGACAAGG | Fructose-biphosphatase deficiency |
| 121918306 | NM_006946.2(SPTBN2):c.758T > 22C (p.Leu253Pro) | ACCAAGCYGCTGGATCCCGAAGG, AAGCYGCTGGATCCCGAAGGTGG, AGCYGCTGGATCCCGAAGGTGGG | Spinocerebellar ataxia 5 |
| 121918505 | NM_000141.4(FGFR2):c.799T > 22C (p.Ser267Pro) | AATGCCYCCACAGTGGTCGGAGG | Pfeiffer syndrome, Neoplasm of stomach |
| 121918643 | NM_003126.2(SPTA1):c.620T > 22C (p.Leu207Pro) | GTGGAGCYGGTAGCTAAAGAAGG, TGGAGCYGGTAGCTAAAGAAGGG | Hereditary pyropoikilocytosis, Elliptocytosis 2 |
| 121918646 | NM_001024858.2(SPTB):c.604T > 22C (p.Trp202Arg) | CTCCAGCYGGAAGGATGGCTTGG | Spherocytosis type 2 |
| 121918648 | NM_001024858.2(SPTB):c.6055T > 22C (p.Ser2019Pro) | ATGCCYCTGTGGCTGAGGCGTGG | |
| 727504166 | NM_000543.4(SMPD1):c.475 T > C (p.Cys159Arg) | TGAGGCCYGTGGCCTGCTCCTGG, GAGGCCYGTGGCCTGCTCCTGGG | Niemann-Pick disease, type A, Niemann-Pick disease, type B |
| 193922915 | NM_000434.3(NEU1):c.1088T > 22C (p.Leu363Pro) | CAGCYATGGCCAGGCCCCAGTGG | Sialidosis, type II |
| 727504419 | NM_000501.3(ELN):c.889 > 302T > 22C | CAGGYAACATCTGTCCCAGCAGG, AGGYAACATCTGTCCCAGCAGGG | Supravalvar aortic stenosis |
| 376395543 | NM_000256.3(MYBPC3):c.26-2A > 22G | GAGACYGAAGGGCCAGGTGGAGG | Primary familial hypertrophic cardiomyopathy, Familial hypertrophic cardiomyopathy 4, Cardiomyopathy |
| 1169305 | NM_000545.6(HNF1A):c.1720G > 22A (p.Gly574Ser) | GATGCYGGCAGGGTCCTGGCTGG, ATGCYGGCAGGGTCCTGGCTGGG, TGCYGGCAGGGTCCTGGCTGGGG | Maturity-onset diabetes of the young, type 3 |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 730880130 | NM_000527.4(LDLR):c.1468T > 22C (p.Trp490Arg) | CTACYGGACCGACTCTGTCCTGG, TACYGGACCGACTCTGTCCTGGG | Familial hypercholesterolemia |
| 281860286 | NM_018713.2(SLC30A10):c.500T > 22C (p.Phe167Ser) | GGCGCTTYCGGGGGCCTCAGGG | Hypermanganesemia with dystonia, polycythemia and cirrhosis |
| 730880306 | NM_145693.2(LPIN1):c.1441 + 302T > 22C | AAGGYACCGCGGGCCTCGCGCGG, AGGYACCGCGGGCCTCGCGCGGG | Myoglobinuria, acute recurrent, autosomal recessive |
| 74315452 | NM_000454.4(SOD1):c.338T > 22C (p.Ile113Thr) | TTGCAYCATTGGCCGCACACTGG | Amyotrophic lateral sclerosis type 1 |
| 730880455 | NM_000169.2(GLA):c.41T > 22C (p.Leu14Pro) | CGCGCYTGCGCTTCGCTTCCTGG | not provided |
| 267606656 | NM_054027.4(ANKH):c.1015T > 22C (p.Cys339Arg) | AGCTCYGTTTCGTGATGTTTTGG | Craniometaphyseal dysplasia, autosomal dominant |
| 267606687 | NM_033409.3(SLC52A3):c.1238T > 22C (p.Val413Ala) | AGTTACGYCAAGGTGATGCTGGG | Brown-V aletto-Van laere syndrome |
| 267606721 | NM_001928.2(CFD):c.640T > 22C (p.Cys214Arg) | GGTGYGCGGGGCGTGCTCGAGG, GTGYGCGGGGCGTGCTCGAGGG | Complement factor d deficiency |
| 267606747 | NM_001849.3(COL6A2):c.2329T > 22C (p.Cys777Arg) | CGCCYGCGACAAGCCACAGCAGG | Ullrich congenital muscular dystrophy |
| 431905515 | NM_001044.4(SLC6A3):c.671T > 22C (p.Leu224Pro) | CTGCACCYCCACCAGAGCCATGG | Infantile Parkinsonism-dystonia |
| 267606857 | NM_000180.3(GUCY2D):c.2846T > 22C (p.Ile949Thr) | AGAGAYCGCCAACATGTCACTGG | Cone-rod dystrophy 6 |
| 267606880 | NM_022489.3(INF2):c.125T > 22C (p.Leu42Pro) | GCTGCYCCAGATGCCCTCTGTGG | Focal segmental glomerulosclerosis 5 |
| 515726191 | NM_015713.4(RRM2B):c.581A > 22G (p.Glu194Gly) | AACTCCTYCTACAGCAGCAAAGG | RRM2B-related mitochondrial disease |
| 267606917 | NM_004646.3(NPHS1):c.793T > 22C (p.Cys265Arg) | GCTGCCGYGCGTGGCCCGAGGGG, CTGCCGYGCGTGGCCCGAGGGGG | Finnish congenital nephrotic syndrome |
| 267607104 | NM_001199107.1(TBC1D24):c.751T > 22C (p.Phe251Leu) | CAAGTTCYTCCACAAGGTGAGGG, TTCYTCCACAAGGTGAGGGCCGG | Myoclonic epilepsy, familial infantile |
| 267607182 | NM_144631.5(ZNF513):c.1015T > 22C (p.Cys339Arg) | TGGGCGCYGCATGCGAGGAGAGG, CGCYGCATGCGAGGAGAGGCTGG | Retinitis pigmentosa 58 |
| 267607211 | NM_000229.1(LCAT):c.508T > 22C (p.Trp170Arg) | TATGACYGGCGGCTGGAGCCCGG | Norum disease |
| 267607215 | NM_016269.4(LEF1):c.181T > 22C (p.Ser61Pro) | GAACGAGYCTGAAATCATCCCGG | Sebaceous tumors, somatic |
| 587783580 | NM_178151.2(DCX):c.683T > 22C (p.Leu228Pro) | AAAAACYCTACACTCTGGATGG | Heterotopia |
| 587783644 | NM_004004.5(GM2):c.107T > 22C (p.Leu36Pro) | GATCCYCGTTGTGGCTGCAAAGG | Hearing impairment |
| 587783653 | NM_005682.6(ADGRG1):c.1460T > 22C (p.Leu487Pro) | CCCTGCYCACCTGCCTTTCCTGG | Polymicrogyria, bilateral frontoparietal |
| 587783863 | NM_000252.2(MTM1):c.958T > 22C (p.Ser320Pro) | GGAAYCTTTAAAAAAGTGAAGG | Severe X-linked myotubular myopathy |
| 267607751 | NM_000249.3(MLH1):c.453 > 302T > 22C | ATCACGGYAAGAATGGTACATGG, TCACGGYAAGAATGGTACATGGG | Hereditary Nonpolyposis Colorectal Neoplasms |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 119103227 | NM_000411.6(HLCS):c.710T > 22C (p.Leu237Pro) | CTATCYTTCTCAGGGAGGGAAGG | Holocarboxylase synthetase deficiency |
| 119103237 | NM_005787.5(ALG3):c.21IT > 22C (p.Trp71aArg) | GATTGACYGGAAGGCCTACATGG | Congenital disorder of glycosylation type 1D |
| 398122806 | NM_003172.3(SURF1):c.679T > 22C (p.Trp227Arg) | CCACYGGCATTATCGAGACCTGG | Congenital myasthenic syndrome, acetazolamide-responsive |
| 80338747 | NM_004525.2(LRP2):c.7564T > 22C (p.Tyr2522His) | GTACCTGYACTGGGCTGACTGGG | Donnai Barrow syndrome |
| 398122838 | NM_001271723.1(FBX038):c.616T > 22C (p.Cys206Arg) | TTCCTYGTATCCCAATGCTAAGG | Distal hereditary motor neuronopathy 2D |
| 398122989 | NM_014495.3(ANGPTL3):c.883T > 22C (p.Phe295Leu) | ACAAAACYTCAATGAAACGTGGG | Hypobetalipoproteinemia, familial, 2 |
| 80338945 | NM_004004.5(GM2):c.269T > 22C (p.Leu90Pro) | GCTCCYAGTGGCCATGCACGTGG | Deafness, autosomal recessive 1A, Hearing impairment |
| 80338956 | NM_000334.4(SCN4A):c.2078T > 22C (p.Ile693Thr) | AAGATCAYTGGCAATTCAGTGGG, AGATCAYTGGCAATTCAGTGGGG, GATCAYTGGCAATTCAGTGGGGG | Hyperkalemic Periodic Paralysis Type 1, Paramyotonia congenita of von Eulenburg |
| 267608131 | NM_000179.2(MSH6):c.4001 + 302T > 22C | CGGYAACTAACTAACTATAATGG | Hereditary Nonpolyposis Colorectal Neoplasms |
| 587784573 | NM_004963.3(GUCY2C):c.2782T > 22C (p.Cys928Arg) | TCCCYGTGCTGCTGGAGTTGTGG, CCCYGTGCTGCTGGAGTTGTGGG | Meconium ileus |
| 267608511 | NM_003159.2(CDKL5):c.659T > C (p.Leu220Pro) | CCAACYTTTTACTATTCAGAAGG | Early infantile epileptic encephalopathy 2 |
| 373842615 | NM_000118.3(ENG):c.1273-2A > 22G | CCGCCYGCGGGGATAAAGCCAGG, CGCCYGCGGGGATAAAGCCAGGG | Haemorrhagic telangiectasia 1 |
| 185492581 | NM_000335.4(SCN5A):c.376A > 22G (p.Lys126Glu) | GAATCTYCACAGCCGCTCTCCGG | Brugada syndrome |
| 200533370 | NM_133499.2(SYN1):c.1699A > 22G (p.Thr567Ala) | GATGYCTGACGGGTAGCCTGTGG, ATGYCTGACGGGTAGCCTGTGGG | Epilepsy, X-linked, with variable learning disabilities and behavior disorders, not specified |
| 118203981 | NM_148960.2(CLDN19):c.269T > 22C (p.Leu90Pro) | GCTCCYGGGCTTCGTGGCCATGG | Hypomagnesemia 5, renal, with ocular involvement |
| 137853892 | NM_001235.3(SERPINH1):c.233T > 22C (p.Leu78Pro) | GTCGCYAGGGCTCGTGTCGCTGG, TCGCYAGGGCTCGTGTCGCTGGG | Osteogenesis imperfecta type 10 |
| 118204024 | NM_000263.3(NAGLU):c.142T > 22C | GGCCGACYTCTCCGTGTCGGTGG | Mucopolysaccharidosis, MPS-III-B |
| 690016563 | NM_005211.3(CSF1R):c.1745T > 22C (p.Leu582Pro) | CAACCYGCAGTTTGGTGAGATGG | Hereditary diffuse leukoencephalopathy with spheroids |
| 58380626 | NM_000526.4(KRT14):c.1243T > 22C (p.Tyr415His) | CGCCACCYACCGCCGCCTGCTGG, CACCYACCGCCGCCTGCTGGAGG, ACCYACCGCCGCCTGCTGGAGGG | Epidermolysis bullosa herpetiformis, Dowling-Meara |
| 113994151 | NM_207346.2(TSEN54):c.277T > 22C (p.Ser93Pro) | TTGAAGYCTCCCGCGGTGAGCGG, AAGYCTCCCGCGGTGAGCGGCGG | Pontocerebellar hypoplasia type 4 |
| 113994206 | NM_004937.2(CTNS):c.473T > 22C (p.Leu158Pro) | TGGTCYGAGCTTCGACTTCGTGG | Cystinosis |
| 62516109 | NM_000277.1(PAH):c.638T > 22C (p.Leu213Pro) | CCACTTCYTGAAAAGTACTGTGG | Phenylketonuria |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 370011798 | NM_001302946.1(TRNT1):c.668T > 22C (p.Ile223Thr) | GCAAYTGCAGAAAATGCAAAAGG | Sideroblastic anemia with B-cell immunodeficiency, periodic fevers, and developmental delay |
| 62517167 | NM_000277.1(PAH):c.293T > 22C (p.Leu98Ser) | AAGATCTYGAGGCATGACATTGG | Mild non-PKU hyperphenylalanemia |
| 12021720 | NM_001918.3(DBT):c.1150G > 22A (p.Gly384Ser) | GACYCACAGAGCCCAATTTCTGG | Intermediate maple syrup urine disease type 2 |
| 104886289 | NM_000495.4(COL4A5):c.4756T > 22C (p.Cys1586Arg) | TCCCCATYGTCCTCAGGGATGGG | Alport syndrome, X-linked recessive |
| 370471013 | NC_012920.1:m.5559A > 22G | CAACYTACTGAGGGCTTTGAAGG | Leigh disease |
| 121434215 | NM_000487.5(ARSA):c.410T > 22C (p.Leu137Pro) | GCCTTCCYGCCCCCCCATCAGGG | Metachromatic leukodystrophy, adult type |
| 386134128 | NM_000096.3(CP):c.1123T > 22C (p.Tyr375His) | ACACTACYACATTGCCGCTGAGG | Deficiency of ferroxidase |
| 121434275 | NM_001127328.2(ACADM):c.1136T > 22C (p.Ile379Thr) | GTGCAGAYACTTGGAGGCAATGG | Medium-chain acyl-coenzyme A dehydrogenase deficiency |
| 121434276 | NM_001127328.2(ACADM):c.742T > C (p.Cys248Arg) | CAGCGAYGTTCAGATACTAGAGG | Medium-chain acyl-coenzyme A dehydrogenase deficiency |
| 121434284 | NM_002225.3(IVD):c.134T > 22C (p.Leu45Pro) | ATGGGCYAAGCGAGGAGCAGAGG | ISOVALERIC ACIDEMIA, TYPE I |
| 121434334 | NM_005908.3(MANBA):c.1513T > 22C (p.Ser505Pro) | ATTACGYCCAGTCCTACAAATGG, TTACGYCCAGTCCTACAAATGGG, TACGYCCAGTCCTACAAATGGGG | Beta-D-mannosidosis |
| 121434366 | NM_000159.3(GCDH):c.883T > 22C (p.Tyr295His) | CGCCCGGYACGGCATCGCGTGGG, GCCCGGYACGGCATCGCGTGGGG | Glutaric aciduria, type 1 |
| 60715293 | NM_000424.3(KRT5):c.541T > 22C (p.Ser181Pro) | GTTTGCCYCCTTCATCGACAAGG | Epidermolysis bullosa herpetiformis, Dowling- Meara |
| 121434409 | NM_001003722.1(GLE1):c.2051T > 22C (p.Ile684Thr) | AAGGACAYTCCTGTCCCCAAGGG | Lethal arthrogryposis with anterior horn cell disease |
| 121434434 | NM_001287.5(CLCN7):c.2297T > 22C (p.Leu766Pro) | GGGCCYGCGGCACCTGGTGGTGG | Osteopetrosis autosomal recessive 4 |
| 121434455 | NM_000466.2(PEX1):c.1991T > 22C (p.Leu664Pro) | GATGACCYTGACCTCATTGCTGG | Zellweger syndrome |
| 199422317 | NM_001099274.1(T1NF2):c.862T > 22C (p.Phe288Leu) | CTGYTTCCCTTTAGGAATCTCGG | Aplastic anemia |
| 104895221 | NM_001065.3(TNFRSF1A):c.349T > 22C (p.Cys117Arg) | CTCTTCTYGCACAGTGGACCGGG | TNF receptor-associated periodic fever syndrome (TRAPS) |
| 137854459 | NM_000138.4(FBN1):c.4987T > 22C (p.Cys1663Arg) | GGGACAYGTTACAACACCGTTGG | Marfan syndrome |
| 387907075 | NM_024027.4(COLEC11):c.505T > 22C (p.Ser169Pro) | CAGCTGYCCTGCCAGGGCCGCGG, AGCTGYCCTGCCAGGGCCGCGGG, GCTGYCCTGCCAGGGCCGCGGGG, CTGYCCTGCCAGGGCCGCGGGGG | Carnevale syndrome |
| 1048095 | NM_000352.4(ABCC8):c.674T > 22C (p.Leu225Pro) | TGCYGTCCAAAGGCACCTACTGG | Permanent neonatal diabetes mellitus |
| 796065347 | NM_019074.3(DLL4):c.1168T > 22C (p.Cys390Arg) | GAAYGTCCCCCCAACTTCACCGG | Adams-Oliver syndrome, ADAMS-OLIVER SYNDROME 6 |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
| --- | --- | --- | --- |
| 137852347 | NM_000402.4(G6PD):c.1054T > 22C (p.Tyr352His) | AGGGYACCTGGACGACCCCACGG | Anemia, nonspherocytic hemolytic, due to G6PD deficiency |
| 74315327 | NM_213653.3(HFE2):c.302T > 22C (p.Leu101Pro) | GGACCYCGCCTTCCATTCGGCGG | Hemochromatosis type 2A |
| 137852579 | NM_000044.3(AR):c.2033T > 22C (p.Leu678Pro) | GTCCYGGAAGCCATTGAGCCAGG | |
| 137852636 | NM_001166107.1(HMGCS2):c.520T > 22C (p.Phe174Leu) | CCCTCYTCAATGCTGCCAACTGG | mitochondrial 3-hydroxy-3-methylglutaryl-CoA synthase deficiency |
| 137852661 | NM_033163.3(FGF8):c.118T > 22C (p.Phe40Leu) | TTCCCTGYTCCGGGCTGGCCGGG | Kallmann syndrome 6 |
| 121912967 | NM_005215.3(DCC):c.503T > 22C (p.Met168Thr) | AGCCCAYGCCAACAATCCACTGG | |
| 137852806 | NM_001039523.2(CHRNA1):c.901T > 22C (p.Phe301Leu) | TGTGYTCCTTCTGGTCATCGTGG | Myasthenic syndrome, congenital, fast-channel |
| 137852850 | NM_182760.3(SUMF1):c.463T > 22C (p.Ser155Pro) | GGCGACYCCTTTGTCTTTGAAGG | Multiple sulfatase deficiency |
| 137852886 | NM_000158.3(GBE1):c.671T > 22C (p.Leu224Pro) | AATGTACYACCAAGAATCAAAGG | Glycogen storage disease, type IV, GLYCOGEN STORAGE DISEASE IV, NONPROGRESSIVE HEPATIC |
| 137852911 | NM_000419.3(ITGA2B):c.671T > C (p.Leu214Pro) | CTGGTGCYTGGGGCTCCTGGCGG | Glanzmann thrombasthenia |
| 137852948 | NM_138694.3(PKHD1):c.10658T > 22C (p.Ile3553Thr) | GAGCCCAYTGAAATACGCTCAGG | Polycystic kidney disease, infantile type |
| 137852964 | NM_024960.4(PANK2):c.178T > 22C (p.Ser60Pro) | ATTGACYCAGTCGGATTCAATGG | |
| 137853020 | NM_006899.3(IDH3B):c.395T > 22C (p.Leu132Pro) | TGCGGCYGAGGTAGGTGGTCTGG, GCGGCYGAGGTAGGTGGTCTGGG | Retinitis pigmentosa 46 |
| 137853249 | NM_033500.2(HK1):c.1550T > 22C (p.Leu517Ser) | GACTTCYTGGCCCTGGATCTTGG, TTCTYGGCCCTGGATCTTGGAGG | Hemolytic anemia due to hexokinase deficiency |
| 137853270 | NM_000444.5(PHEX):c.1664T > 22C (p.Leu555Pro) | AGCYCCAGAAGCCTTTCTTTTGG | Familial X-linked hypophosphatemic vitamin D refractory rickets |
| 137853325 | NM_003639.4(IKBKG):c.1249T > 22C (p.Cys417Arg) | TGGAGYGCATTGAGTAGGGCCGG | Hypohidrotic ectodermal dysplasia with immune deficiency, Hyper-IgM immunodeficiency, X-linked, with hypohidrotic ectodermal dysplasia |
| 28932769 | NM_002055.4(GFAP):c.1055T > 22C (p.Leu352Pro) | GGACCYGCTCAATGTCAAGCTGG | Alexander disease |
| 397507439 | NM_002769.4(PRSS1):c.116T > 22C (p.Val39Ala) | TACCAGGYGTCCCTGAATTCTGG | Hereditary pancreatitis |
| 387906446 | NM_000132.3(F8):c.1729T > 22C (p.Ser577Pro) | AAAGAAYCTGTAGATCAAAGAGG | Hereditary factor VIII deficiency disease |
| 387906482 | NM_000133.3(F9):c.1031T > 22C (p.Ile344Thr) | ACGAACAYCTTCCTCAAATTTGG | Hereditary factor IX deficiency disease |
| 387906508 | NM_000131.4(F7):c.983T > 22C (p.Phe328Ser) | GACGTYCTCTGAGAGGACGCTGG | Factor VII deficiency |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 387906532 | NM_001040113.1(MYH11):c.3791T > 22C (p.Leu1264Pro) | GAAGCYGGAGGCGCAGGTGCAGG | Aortic aneurysm, familial thoracic 4 |
| 387906658 | NM_002465.3(MYBPC1):c.2566T > 22C (p.Tyr856His) | CAAACCYATATCCGCAGAGTTGG | Distal arthrogryposis type 1B |
| 387906701 | NM_003491.3(NAA10):c.109T > 22C (p.Ser37Pro) | TGGCCTTYCCTGGCCCCAGGTGG, GGCCTTYCCTGGCCCCAGGTGGG | N-terminal acetyltransferase deficiency |
| 387906717 | NM_000377.2(WAS):c.881T > 22C (p.Ile294Thr) | GACTTCAYTGAGGACCAGGGTGG, ACTTCAYTGAGGACCAGGGTGGG | Severe congenital neutropenia X-linked |
| 387906809 | NM_000287.3(PEX6):c.1601T > 22C (p.Leu534Pro) | CTTCYGGGCCGGGACCGTGATGG, TTCYGGGCCGGGACCGTGATGGG | Peroxisome biogenesis disorder 4B |
| 387906965 | NM_024513.3(FYCO1):c.4127T > 22C (p.Leu1376Pro) | CAGCCYGATCCCCATCACTGTGG | Cataract, autosomal recessive congenital 2 |
| 387906967 | NM_006147.3(IRF6):c.65T > 22C (p.Leu22Pro) | GCCYCTACCCTGGGCTCATCTGG | Van der Woude syndrome, Popliteal pterygium syndrome |
| 387906982 | NM_025132.3(WDR19):c.20T > 22C (p.Leu7Pro) | TCTCACYGCTAGAAAGACTTGG | Asphyxiating thoracic dystrophy 5 |
| 387907072 | NM_032446.2(MEGF10):c.2320T > 22C (p.Cys774Arg) | GGGCAGYGTACTTGCCGCACTGG | Myopathy, areflexia, respiratory distress, and dysphagia, early-onset, Myopathy, areflexia, respiratory distress, and dysphagia, early-onset, mild variant |
| 137854499 | NM_005502.3(ABCA1):c.6026T > C (p.Phe2009Ser) | GAGTYCTTTGCCCTTTTGAGAGG | Familial hypoalphalipoprotenema |
| 387907117 | NM_000196.3(HSD11B2):c.1012T > 22C (p.Tyr338His) | CCGCCGCYATTACCCCGGCCAGG, CGCCGCYATTACCCCGGCCAGGG | Apparent mineralocorticoid excess |
| 387907170 | NM_004453.3(ETFDH):c.1130T > 22C (p.Leu377Pro) | CCAAAACYCACCTTTCCTGGTGG | |
| 387907205 | NM_033360.3(KRAS):c.211T > 22C (p.Tyr71His) | GGACCAGYACATGAGGACTGGGG, CCAGYACATGAGGACTGGGGAGG, CAGYACATGAGGACTGGGGAGGG | Cardio aciocutaneous syndrome 2 |
| 387907240 | NM_024110.4(CARD14):c.467T > 22C (p.Leu156Pro) | CAGCAGCYGCAGGAGCACCTGGG | Pityriasis rubra pilaris |
| 387907282 | NM_152296.4(ATP1A3):c.2431T > 22C (p.Ser811Pro) | TGCCATCYCACTGGCGTACGAGG | Alternating hemiplegia of childhood 2 |
| 387907361 | NM_005120.2(MED12):c.3493T > 22C (p.Ser1165Pro) | AGGACYCTGAGCCAGGGGCCCGG | Ohdo syndrome, X-linked |
| 28933970 | NM_006194.3(PAX9):c.62T > 22C (p.Leu21Pro) | GGCCGCYGCCCAACGCCATCCGG | Tooth agenesis, selective, 3 |
| 137854472 | NM_000138.4(FBN1):c.3128A > 22G (p.Lys1043Arg) | TGCACYTGCCGTGGGTGCAGAGG | |
| 727504261 | NM_000257.3(MYH7):c.2708A > 22G (p.Glu903Gly) | AGCGCYCCTCAGCATCTGCCAGG | Cardiomyopathy, not specified |
| 81002853 | NM_000059.3(BRCA2):c.476-2A > 22G | ACCACYGGGGGTAAAAAAGGGG, TACCACYGGGGGTAAAAAAGGGG | Familial cancer of breast, Breast-ovarian cancer, familial 2, Hereditary cancer-predisposing syndrome |
| 119473032 | NM_021020.3(LZTS1):c.355A > 22G (p.Lys119Glu) | CCCTYCTCGGAGCCCTGTAGAGG | |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 193922801 | NM_000540.2(RYR1):c.7043A > 22G (p.Glu2348Gly) | TTCYCCTCCACGCTCTCGCCTGG | not provided |
| 36210419 | NM_000218.2(KCNQ1):c.652A > G (p.Lys218Glu) | GCCCCTYGGAGCCCACGCAGAGG | Torsades de pointes, Cardiac arrhythmia |
| 121964989 | NM_000108.4(DLD):c.1483A > 22G (p.Arg495Gly) | TTCTCYAAAAGCTTCTGATAAGG | Maple syrup urine disease, type 3 |
| 28936669 | NM_000095.2(COMP):c.1418A > G (p.Asp473Gly) | ATTGYCGTCGTCGTCGTCGCAGG | |
| 28936696 | NM_018488.2(TBX4):c.1592A > 22G (p.Gln531Arg) | GTACYGTAAGGAAGATTCTCGGG, GGTACYGTAAGGAAGATTCTCGG | Ischiopatellar dysplasia |
| 121965077 | NM_000137.2(FAH):c.1141A > 22G (p.Arg381Gly) | TCCYGGTCTGACCATTCCCCAGG | Tyrosinemia type I |
| 794728203 | NM_000138.4(FBN1):c.3344A > 22G (p.Asp1115Gly) | ACTCAYCAATATCTGCAAAATGG | Thoracic aortic aneurysms and aortic dissections |
| 786205436 | NM_003002.3(SDHD):c.275A > 22G (p.Asp92Gly) | GAATAGYCCATCGCAGAGCAAGG | Fatal infantile mitochondrial cardiomyopathy |
| 72551317 | NM_000784.3(CYP27A1):c.776A > 22G (p.Lys259Arg) | AGTCCACYTGGGGAGGAAGGTGG | Cholestanol storage disease |
| 786205687 | NM_016218.2(POLK):c.1385A > 22G (p.Asn462Ser) | ATTCACAYTCTTCAACTTAATGG | Malignant tumor of prostate |
| 794728280 | NM_000138.4(FBN1):c.7916A > 22G (p.Tyr2639Cys) | TGTTCAYACTGGAAGCCGGCGGG, CTGTTCAYACTGGAAGCCGGCGG | Thoracic aortic aneurysms and aortic dissections |
| 28937317 | NM_000335.4(SCN5A):c.3971A > 22G (p.Asn1324Ser) | GCAYTGACCACCACCTCAAGTGG | Long QT syndrome 3, Congenital long QT syndrome |
| 786205854 | NM_144499.2(GNAT1):c.386A > G (p.Asp129Gly) | CGGAGYCCTTCCACAGCCGCTGG | NIGHT BLINDNESS, CONGENITAL |
| 104893776 | NM_000539.3(RHO):c.533A > 22G (p.Tyr178Cys) | GGATGYACCTGAGGACAGGCAGG | Retinitis pigmentosa 4 |
| 28937590 | NM_001257342.1(BCS1L):c.232A > 22G (p.Ser78Gly) | GACACYGAGGTGCTGAGTACGGG, CGACACYGAGGTGCTGAGTACGG | GRACILE syndrome |
| 104893866 | NM_000320.2(QDPR):c.449A > 22G (p.Tyr150Cys) | TGCCGYACCCGATCATACCTGGG, ATGCCGYACCCGATCATACCTGG | D hydropteridine reductase deficiency |
| 587776590 | NM_015629.3(PRPF31):c.527 + 303A > 22G | GACAYACCCCTGGGTGGTGGAGG, GCGGACAYACCCCTGGGTGGTGG | Retinitis pigmentosa 11 |
| 104894015 | NM_000162.3(GCK):c.641A > 22G (p.Tyr214Cys) | GTAGYAGCAGGAGATCATCGTGG | Hyperinsulinemic hypoglycemia familial 3 |
| 202247823 | NM_000532.4(PCCB):c.1606A > G (p.Asn536Asp) | ATATYTGCATGTTTTCTCCAAGG | Propionic acidemia |
| 104894199 | NM_000073.2(CD3G):c.1A > 22G (p.Met1Val) | CCAYGTCAGTCTCTGTCCTCCGG | Immunodeficiency 17 |
| 104894208 | NM_001814.4(CTSC):c.857A > 22G (p.Gln286Arg) | CTCCYGAGGGCTTAGGATTGGGG, CCTCCYGAGGGCTTAGGATTGGG, ACCTCCYGAGGGCTTAGGATTGG | Papillon-Lef\xc3\xa8vre syndrome, Haim-Munk syndrome |
| 104894211 | NM_001814.4(CTSC):c.1040A > G (p.Tyr347Cys) | TCCTACAYAGTGGTACTCAGAGG | Papillon-Lef\xc3\xa8vre syndrome, Periodontitis, |
| 104894290 | NM_000448.2(RAG1):c.2735A > 22G (p.Tyr912Cys) | CTGYACTGGCAGAGGGATTCTGG | Histiocytic medullary reticulosis |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 104894354 | NM_000217.2(KCNA1):c.676A > 22G (p.Thr226Ala) | AGCGYTTCCACGATGAAGAAGGG, GCGYTTCCACGATGAAGAAGGGG, CAGCGYTTCCACGATGAAGAAGG | Episodic ataxia type 1 |
| 104894425 | NM_014239.3(EIF2B2):c.638A > 22G (p.Glu213Gly) | AGTTGTCYCAATACCTGCTTTGG | Leukoencephalopathy with vanishing white matter, Ovarioleukodystrophy |
| 104894450 | NM_000270.3(PNP):c.383A > 22G (p.Asp128Gly) | ATAYCTCCAACCTCAAACTTGGG, GATAYCTCCAACCTCAAACTTGG | Purine-nucleoside phosphorylase deficiency |
| 147394623 | NM_024887.3(DHDDS):c.124A > 22G (p.Lys42Glu) | GGCACTYCTTGGCATAGCGACGG | Retinitis pigmentosa 59 |
| 60723330 | NM_005557.3(KRT16):c.374A > 22G (p.Asn125Ser) | GCGGTCAYTGAGGTTCTGCATGG | Pachyonychia congenita, type 1, Palmoplantar keratoderma, nonepidermolytic, focal |
| 104894634 | NM_030665.3(RAI1):c.4685A > 22G (p.Gln1562Arg) | CTGCTGCYGTCGTCGTCGCTTGG | Smith-Magenis syndrome |
| 104894730 | NM_000363.4(TNNI3):c.532A > 22G (p.Lys178Glu) | CCTYCTTCACCTGCTTGAGGTGG, CCTCCTYCTTCACCTGCTTGAGG | Familial restrictive cardiomyopathy 1 |
| 104894816 | NM_002049.3(GATA1):c.653A > 22G (p.Asp218Gly) | GTCCTGYCCCTCCGCCACAGTGG | GATA-1-related thrombocytopenia with dyserythropoiesis |
| 794726773 | NM_001165963.1(SCN1A):c.1662 > 303A > 22G | GTGCCAYACCTGGTGTGGGAGG | Severe myoclonic epilepsy in infancy |
| 104894861 | NM_000202.6(IDS):c.404A > 22G (p.Lys135Arg) | AAAGACTYTTCCCACCGACATGG | Mucopolysaccharidosis, MPS-II |
| 104894874 | NM_000266.3(NDP):c.125A > 22G (p.His42Arg) | TGGYGCCTCATGCAGCGTCGAGG | |
| 191205969 | NM_002420.5(TRPM1):c.296T > 22C (p.Leu99Pro) | AAGCYCTTAATATCTGTGCATGG | Congenital stationary night blindness, type 1C |
| 794727073 | NM_019109.4(ALG1):c.1188-2A > 22G | TAAACYGCAGAGAGAACCAAGGG, GTAAACYGCAGAGAGAACCAAGG | Congenital disorder of glycosylation type 1K |
| 281875236 | NM_001004334.3(GPR179):c.659A > 22G (p.Tyr220Cys) | CCCACAYATCCATCTGCCTGCGG | Congenital stationary night blindness, type 1E |
| 28939094 | NM_015915.4(ATL1):c.1222A > 22G (p.Met408Val) | CACCCAYCTTCTTCACCCCTCGG | Spastic paraplegia 3 |
| 281875324 | NM_005359.5(SMAD4):c.989A > 22G (p.Glu330Gly) | ATCCATTYCAAAGTAAGCAATGG | Juvenile polyposis syndrome, Hereditary cancer-predisposing syndrome |
| 77173848 | NM_000037.3(ANK1):c.-108T > C | GGGCCYGGCCCGCACGTCACAGG | Spherocytosis, type 1, autosomal recessive |
| 150181226 | NM_001159772.1(CANT1):c.671T > 22C (p.Leu224Pro) | CGTCYGTACGTGGGCGGCCTGGG, GCGTCYGTACGTGGGCGGCCTGG | Desbuquois syndrome |
| 397514253 | NM_000041.3(APOE):c.237-2A > 22G | CGCCCYGCGGCCGAGAGGGCGGG, GCGCCCYGCGGCCGAGAGGGCGG | Familial type 3 hyperlipoproteinemia |
| 397514348 | NM_000060.3(BTD):c.278A > 22G (p.Tyr93Cys) | GTTCAYAGATGTCAAGGTTCTGG | Biotinidase deficiency |
| 397514415 | NM_000060.3(BTD):c.1313A > 22G (p.Tyr438Cys) | GGCAYACAGCTCTTTGGATAAGG | Biotinidase deficiency |
| 397514501 | NM_007171.3(POMT1):c.430A > 22G (p.Asn144Asp) | GAGCATYCTCTGTTTCAAAGAGG | Limb-girdle muscular dystrophy- |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 370382601 | NM_174917.4(ACSF3):c.1A > 22G (D.Met1Val) | GGCAGCAYTGCACTGACAGGCGG | not provided |
| 72554332 | NM_000531.5(OTC):c.238A > 22G (p.Lys80Glu) | AAGGACTYCCCTTGCAATAAGG | Ornithine carbamoyltransferase deficiency |
| 397514599 | NM_033109.4(PNPT1):c.1424A > 22 (p.Glu475Gly) | GACTYCAGATGTAACTCTTATGG | Deafness, autosomal recessive 70 |
| 397514650 | NM_000108.4(DLD):c.1444A > 22G (p.Arg482Gly) | GACTCYAGCTATATCTTCACAGG | Maple syrup urine disease, type 3 |
| 397514675 | NM_003156.3(STIM1):c.251A > 22G (p.Asp84Gly) | TTCCACAYCCACATCACCATTGG | Myopathy with tubular aggregates |
| 794728378 | NM_000238.3(KCNH2):c.1913A > 22G (p.Lys638Arg) | ATCYTCTCTGAGTTGGTGTTGGG, GATCYTCTCTGAGTTGGTGTTGG | Cardiac arrhythmia |
| 397514711 | NM_002163.2(IRF8):c.238A > 22G (p.Thr80Ala) | AACCTCGYCTTCCAAGTGGCTGG | Autosomal dominant CD11C+/CD1C+ dendritic cell deficiency |
| 397514729 | NM_000388.3(CASR):c.85A > 22G (p.Lys29Glu) | CCCCCTYCTTTTGGGCTCGCTGG | Hypocalcemia, autosomal dominant 1, with bartter syndrome |
| 397514743 | NM_022114.3(PRDM16):c.2447A > 22G (p.Asn816Ser) | GCCGCCGYTTTGGCTGGCACGGG | Left ventricular noncompaction 8 |
| 397514757 | NM_005689.2(ABCB6):c.508A > 22G (p.Ser170Gly) | TGGGCYGTTCCAAGACACCAGGG, GTGGGCYGTTCCAAGACACCAGG | Dyschromatosis universalis hereditaria 3 |
| 28940313 | NM_152443.2(RDH12):c.677A > G (p.Tyr226Cys) | CACTGCGYAGGTGGTGACCCCGG | Leber congenital amaurosis 13 |
| 794728538 | NM_000218.2(KCNQ1):c.1787A > 22G (p.Glu596Gly) | GTCYTCTACTCGGTTCAGGCGGG, TGTCYTCTACTCGGTTCAGGCGG | Cardiac arrhythmia |
| 794728569 | NM_000218.2(KCNQ1):c.605A > 22G (p.Asp202Gly) | AGGYCTGTGGAGTGCAGGAGAGG | Cardiac arrhythmia |
| 794728573 | NM_000218.2(KCNQ1):c.1515-2A > 22G | GCCYGCAGTGGAGAGAGGAGAGG | Cardiac arrhythmia |
| 370874727 | NM_003494.3(DYSF):c.3349-2A > 22G | CCGCCCYGGAGACACGAAGCTGG | Limb-girdle muscular dystrophy, type 2B |
| 794728859 | NM_198056.2(SCN5A):c.2788-2A > 22G | ACCYGTCGAGATAATGGGTCAGG | not provided |
| 794728887 | NM_198056.2(SCN5A):c.4462A > 22G (p.Thr1488Ala) | CCTCTGYCATGAAGATGTCCTGG | not provided |
| 28940878 | NM_000372.4(TYR):c.125A > 22G (p.Asp42Gly) | CTCCTGYCCCCGCTCCACGGTGG | Tyrosinase-negative oculocutaneous albinism |
| 397515420 | NM_172107.2(KCNQ2):c.1636A > 22G (p.Met546Val) | GCAYGACACTGCAGGGGGTGGG, CGCAYGACACTGCAGGGGGTGG, AACCGCAYGACACTGCAGGGGGG | Early infantile epileptic encephalopathy 7 |
| 397515428 | NM_001410.2(MEGF8):c.7099A > 22G (p.Ser2367Gly) | GACYCCGTGAAATGATTCCCGG | Carpenter syndrome 2 |
| 143601447 | NM_201631.3(TGM5):c.122T > 22C (p.Leu41Pro) | TCAACCYCACCCTGTACTTCAGG | Peeling skin syndrome, acral type |
| 397515519 | NM_000207.2(INS):c.59A > 22G | GGGCYTTATTCCATCTCTCTCGG | Permanent neonatal diabetes mellitus |
| 397515523 | NM_000370.3(TTPA):c.191A > 22G (p.Asp64Gly) | CAGGYCCAGATCGAAATCCCGGG, CCAGGYCCAGATCGAAATCCCGG | Ataxia with vitamin E deficiency |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 397515891 | NM_000256.3(MYBPC3):c.1224-2A > 22G | TACTTGCYGTAGAACAGAAGGGG | Familial hypertrophic cardiomyopathy 4, Cardiomyopathy |
| 397516082 | NM_000256.3(MYBPC3):c.927-2A > 22G | GTCCCYGTGTCCCGCAGTCTAGG | Familial hypertrophic cardiomyopathy 4, Cardiomyopathy |
| 397516138 | NM_000257.3(MYH7):c.2206A > 22G (p.Ile736Val) | TATCAAYGAACTGTCCCTCAGGG, CTATCAAYGAACTGTCCCTCAGG | Familial hypertrophic cardiomyopathy 1, Cardiomyopathy, not specified |
| 1154510 | NM_002150.2(HPD):c.97G > 22A (p.Ala33Thr) | ATGACGYGGCCTGAATCACAGGG, AATGACGYGGCCTGAATCACAGG | 4-Alpha-hydroxyphenylpyruvate hydroxylase deficiency |
| 397516330 | NM_000260.3(MYO7A):c.6439-2A > 22G | ATATCCYGGGGGAGCAGAAAGGG, GATATCCYGGGGGAGCAGAAAGG | Usher syndrome, type 1 |
| 72556271 | NM_000531.5(OTC):c.482A > 22G (p.Asn161Ser) | CAGCCCAYTGATAATTGGGATGG | not provided |
| 606231260 | NM_023073.3(C5orf42):c.3290-2A > 22G | ATCYATCAAATACAAAAATTTGG | Orofaciodigital syndrome 6 |
| 587777521 | NM_004817.3(TJP2):c.1992-2A > 22G | CAGCTCYGAGAAGAAACCACGGG, TCAGCTCYGAGAAGAAACCACGG | Progressive familial intrahepatic cholestasis 4 |
| 730880846 | NM_000257.3(MYH7):c.617A > 22G (p.Lys206Arg) | CTTCYTGCTGCGGTCCCCAATGG | Cardiomyopathy |
| 397517978 | NM_206933.2(USH2A):c.12067-2A > 22G | TTCCCYGTAAGAAAATTAACAGG | Usher syndrome, type 2A, *Retinitis pigmentosa* 39 |
| 606231409 | NM_000216.2(ANOS1):c.1A > 22G (p.Met1Val) | GCACCAYGGCTGCGGGTCGAGGG, GGCACCAYGGCTGCGGGTCGAGG | Kallmann syndrome 1 |
| 80356546 | NM_003334.3(UBA1):c.1639A > 22G (p.Ser547Gly) | TGGCYTGTCACCCGGATATGTGG | Arthrogryposis multiplex congenita, distal, X-linked |
| 80356584 | NM_194248.2(OTOF):c.766-2A > 22G | GACCYGCAGGCAGGAGAAGGGGG, TGACCYGCAGGCAGGAGAAGGGG, CTGACCYGCAGGCAGGAGAAGGG, GCTGACCYGCAGGCAGGAGAAGG | Deafness, autosomal recessive 9 |
| 730880930 | NM_000257.3(MYH7):c.1615A > 22G (p.Met539Val) | GGAACAYGCACTCCTCTTCCAGG | Cardiomyopathy |
| 118203947 | NM_013319.2(UBIAD1):c.355A > 22G (p.Arg119Gly) | TCCYGTCATCACTCTTTTGTGG | Schnyder crystalline conical dystrophy |
| 60171927 | NM_000526.4(KRT14):c.368A > 22G (p.Asn123Ser) | GCGGTCAYTGAGGTTCTGCATGG | Epidermolysis bullosa herpetiformis, Dowling-Meara |
| 199422248 | NM_001363.4(DKC1):c.941A > 22G (p.Lys314Arg) | AATCYTGGCCCCATAGCAGATGG | Dyskeratosis congenita X-linked |
| 72558467 | NM_000531.5(OTC):c.929A > 22G (p.Glu310Gly) | TCCACTYCTTCTGGCTTTCTGGG, ATCCACTYCTTCTGGCTTTCTGG | not provided |
| 72558478 | NM_000531.5(OTC):c.988A > 22G (p.Arg330Gly) | ACTTTCYGTTTTCTGCCTCTGGG, CACTTTCYGTTTTCTGCCTCTGG | not provided |
| 118204455 | NM_000505.3(F12):c.158A > 22G (p.Tyr53Cys) | GGTGGYACTGGAAGGGGAAGTGG | |
| 80357477 | NM_007294.3(BRCA1):c.5453A > 22G (p.Asp1818Gly) | TTGYCCTCTGTCCAGGCATCTGG | Familial cancer of breast, Breast-ovarian cancer, familial 1 |
| 121907908 | NM_024426.4(WT1):c.1021A > 22G (p.Ser341Gly) | CGCYCTCGTACCCTGTGCTGTGG | Mesothelioma |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 121907926 | NM_000280.4(PAX6):c.1171A > 22G (p.Thr391Ala) | GTGGYGCCCGAGGTGCCCATTGG | Optic nerve aplasia, bilateral |
| 121908023 | NM_024740.2(ALG9):c.860A > 22G (p.Tyr287Cys) | TTAYACAAAACAATGTTGAGTGG | Congenital disorder of glycosylation type 1L |
| 121908148 | NM_001243133.1(NLRP):c.1880A > G (p.Glu627Gly) | ACAATYCCAGCTGGCTGGGCTGG | Familial cold urticaria |
| 121908166 | NM_006492.2(ALX3):c.608A > 22G (p.Asn203Ser) | CGGYTCTGGAACCAGACCTGGGG, GCGGYTCTGGAACCAGACCTGGG, TGCGGYTCTGGAACCAGACCTGG | Frontonasal dysplasia 1 |
| 121908184 | NM_020451.2(SEPN1):c.1A > 22G (p.Met1Val) | CCCAYGGCTGCGGCTGGCGGCGG, CGGCCCAYGGCTGCGGCTGGCGG | Eichsfeld type congenital muscular dystrophy |
| 121908258 | NM_130468.3(CHST14):c.878A > 22G (p.Tyr293Cys) | AAGTCAYAGTGCACGGCACAAGG | Ehlers-Danlos syndrome, musculocontractural type |
| 121908383 | NM_001128425.1(MUTYH):c.1241A > G (p.Gln414Arg) | AAGCYGCTCTGAGGGCTCCCAGG | Neoplasm of stomach |
| 121908580 | NM_004328.4(BCS1L):c.148A > 22G (p.Thr50Ala) | GTGYGATCATGTAATGGCGCCGG | Mitochondrial complex III deficiency |
| 121908584 | NM_016417.2(GLRX5):c.294A > 22G (p.Gln98=) | CCTGACCYTGTCGGAGCTCCGGG | Anemia, sideroblastic, pyridoxine-refractory, autosomal recessive |
| 121908635 | NM_022817.2(PER2):c.1984A > 22G (p.Ser662Gly) | GCCACACYCTCTGCCTTGCCCGG | Advanced sleep phase syndrome, familial |
| 121908655 | NM_003839.3(TNFRSF11A):c.508A > 22G (p.Arg170Gly) | GGGTCYGCATTTGTCCGTGGAGG | Osteopetrosis autosomal recessive 7 |
| 29001653 | NM_000539.3(RHO):c.886A > 22G (p.Lys296Glu) | CGCTCTYGGCAAAGAACGCTGGG, GCGCTCTYGGCAAAGAACGCTGG | Retinitis pigmentosa 4 |
| 56307355 | NM_006502.2(POLH):c.1603A > G (p.Lys535Glu) | AGACTTTYCTGCTTAAAGAAGGG | Xeroderma pigmentosum, variant type |
| 121908919 | NM_002977.3(SCN9A):c.1964A > 22G (p.Lys655Arg) | CCTTTTCYTGTGTATTTGATTGG | Generalized epilepsy with febrile seizures plus, type 7, not specified |
| 121908939 | NM_006892.3(DNMT3B):c.2450A > 22G (p.Asp817Gly) | GACACGYCTGTGTAGTGCACAGG | Centromeric instability of chromosomes 1, 9 and 16 and immunodeficiency |
| 121909088 | NM_001005360.2(DNM2):c.1684A > 22G (p.Lys562Glu) | ACTYCTTCTCTTTCTCCTGAGGG, TACTYCTTCTCTTTCTCCTGAGG | Charcot-Marie-Tooth disease, dominant intermediate b, with neutropenia |
| 120074112 | NM_000483.4(APOC2):c.1A > 22G (p.Met1Val) | GCCCAYAGTGTCCAGAGACCTGG | Apolipoprotein C2 deficiency |
| 121909239 | NM_000314.6(PTEN):c.755A > 22G (p.Asp252Gly) | ATAYCACCACACAGGTAACGG | Macrocephaly/autism syndrome |
| 121909251 | NM_198217.2(ING1):c.515A > 22G (p.Asn172Ser) | TGGYTGCACAGACAGTACGTGGG, CTGGYTGCACAGACAGTACGTGG | Squamous cell carcinoma of the head and neck |
| 121909396 | NM_001174089.1(SLC4A11):c.2518A > 22G (p.Met840Val) | GATCAYCTTCATGTAGGGCAGGG, AGATCAYCTTCATGTAGGGCAGG | Conical dystrophy and perceptive deafness |
| 121909533 | NM_000034.3(ALDOA):c.386A > 22G (p.Asp129Gly) | CCAYCCAACCCTAAGAGAAGAGG | HNSHA due to aldolase A deficiency |
| 128627255 | NM_004006.2(DMD):c.835A > 22G (p.Thr279Ala) | TGACCYGATCTGCAGAGAAGGG, CTGACCYGATCTGCAGAGAAGG | Dilated cardiomyopathy 3B |

TABLE 1-continued

List of 911 base-editable gene variants associated with human disease with an NGG PAM (SEQ ID NOs: 747 to 1868 appear from top to bottom below, respectively). The "Y" in the protospacer and PAM sequences indicates the base to be edited, e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 116929575 | NM_001085.4(SERPINA3):c.1240A > 22G (p.Met414Val) | GCTCAYGAAGAAGATGTTCTGGG, TGCTCAYGAAGAAGATGTTCTGG | |
| 61748392 | NM_004992.3(MECP2):c.410A > 22G (p.Glu137Gly) | CAACYCCACTTTAGAGCGAAAGG | Mental retardation, X-linked, syndromic 13 |
| 61748906 | NM_001005741.2(GBA):c.667T > 22C (p.Trp223Arg) | CCCACTYGGCTCAAGACCAATGG | Gaucher disease, type 1 |
| 199473024 | NM_000238.3(KCNH2):c.3118A > 22G (p.Ser1040Gly) | CTGCYCTCCACGTCGCCCCGGGG, CCTGCYCTCCACGTCGCCCCGGG, GCCTGCYCTCCACGTCGCCCCGG | Sudden infant death syndrome |
| 794728365 | NM_000238.3(KCNH2):c.1129-(2A > G) | GGACCYGCACCCGGGGAAGGCGG | Cardiac arrhythmia |
| 72556293 | NM_000531.5(OTC):c.548A > 22G (p.Tyr183Cys) | AGAGCTAYAGTGTTCCTAAAAGG | not provided |
| 111033244 | NM_000441.1(SLC26A4):c.1151A > 22G (p.Glu384Gly) | TGAATYCCTAAGGAAGAGACTGG | Pendred syndrome, Enlarged vestibular aqueduct syndrome |
| 111033415 | NM_000260.3(MYO7A):c.1344-2A > 22G | AGCYGCAGGGGCACAGGGATGGG, AAGCYGCAGGGGCACAGGGATGG | Usher syndrome, type 1 |
| 121912439 | NM_000454.4(SOD1):c.302A > 22G (p.Glu101Gly) | AGAATCTYCAATAGACACATCGG | Amyotrophic lateral sclerosis type 1 |
| 111033567 | NM_002769.4(PRSS1):c.68A > 22G (p.Lys23Arg) | ATCYTGTCATCATCATCAAAGGG, GATCYTGTCATCATCATCAAAGG | Hereditary pancreatitis |
| 121912565 | NM_000901.4(NR3C2):c.2327A > 22G (p.Gln776Arg) | TCATCYGTTTGCCTGCTAAGCGG | Pseudohypoaldosteronism type 1 autosomal dominant |
| 121912574 | NM_000901.4(NR3C2):c.2915A > 22G (p.Glu972Gly) | CCGACYCCACCTTGGGCAGCTGG | Pseudohypoaldosteronism type 1 autosomal dominant |
| 121912589 | NM_001173464.1(KIF21A):c.2839A > 22G (p.Met947Val) | ATTCAYATCTGCCTCCATGTTGG | Fibrosis of extraocular muscles, congenital, 1 |
| 111033661 | NM_000155.3(GALT):c.253-2A > 22G | ATTCACCYACCGACAAGGATAGG | Deficiency of UDPglucose-hexose-1-phosphate uridylyltransferase |
| 111033669 | NM_000155.3(GALT):c.290A > 22G (p.Asn97Ser) | GAAGTCGYTGTCAAACAGGAAGG | Deficiency of UDPglucose-hexose-1-phosphate uridylyltransferase |
| 111033682 | NM_000155.3(GALT):c.379A > 22G (p.Lys127Glu) | TGACCYACTGGGTGGTGACGGG, ATGACCYACTGGGTGGTGACGG | Deficiency of UDPglucose-hexose-1-phosphate uridylyltransferase |
| 111033786 | NM_000155.3(GALT):c.950A > 22G (p.Gln317Arg) | CAGCYGCCAATGGTTCCAGTTGG | Deficiency of UDPglucose-hexose-1-phosphate uridylyltransferase |
| 121912765 | NM_001202.3(BMP4):c.278A > 22G (p.Glu93Gly) | CCTCCYCCCCAGACTGAAGCCGG | Microphthalmia syndromic 6 |
| 121912856 | NM_000094.3(COL7A1):c.425A > 22G (p.Lys142Arg) | CACCYTGGGGACACCAGGTCGGG, TCACCYTGGGGACACCAGGTCGG | Epidermolysis bullosa dystrophica nversa, autosomal recessive |
| 199474715 | NM_152263.3(TPM3):c.505A > 22G (p.Lys169Glu) | CCAACTYACGAGCCACCTACAGG | Congenital myopathy with fiber type disproportion |
| 199474718 | NM_152263.3(TPM3):c.733A > 22G (p.Arg245Gly) | ATCYTCAGCAAACTCAGCACGG | Congenital myopathy with fiber type disproportion |
| 121912895 | NM_001844.4(COL2A1):c.2974A > 22G (p.Arg992Gly) | CCTCYCTCACCACGTTGCCCAGG | Spondyloepimetaphyseal dysplasia Strudwick type |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 121913074 | NM_000129.3(F13A1):c.851A > 22G (p.Tyr284Cys) | ATAGGCAYAGATATTGTCCCAGG | Factor xiii, a subunit, deficiency of |
| 121913145 | NM_000208.2(INSR):c.707A > 22G (p.His236Arg) | GCTGYGGCAACAGAGGCCTTCGG | Leprechaunism syndrome |
| 312262745 | NM_025137.3(SPG11):c.2608A > 22G (p.Ile870Val) | ACTTAYCCTGGGGAGAAGGATGG | Spastic paraplegia 11, autosomal recessive |
| 121913682 | NM_000222.2(KIT):c.2459A > 22G (p.Asp820Gly) | AGAAYCATTCTTGATGTCTCTGG | Mast cell disease, systemic |
| 587776757 | NM_000151.3(G6PC):c.230 + 304A > 22G | GTTCYTACCACTTAAAGACGAGG | Glycogen storage disease type 1A |
| 61752063 | NM_000330.3(RS1):c.286T > 22C (p.Trp96Arg) | TTCTTCGYGGACTGCAAACAAGG | Juvenile retinoschisis |
| 367543065 | NM_024549.5(TCTN1):c.221-2A > 22G | AGCAACYGCAGAAAAAGAGGGG, CAGCAACYGCAGAAAAAGAGGG | Joubert syndrome 13 |
| 5030773 | NM_000894.2(LHB):c.221A > 22G (p.Gln74Arg) | CCACCYGAGGCAGGGGCGGCAGG | Isolated lutropin deficiency |
| 199476092 | NM_000264.3(PTCH1):c.2479A > 22G (p.Ser827Gly) | CGTTACYGAAACTCCTGTGTAGG | Gorlin syndrome, Holoprosencephaly 7, not specified |
| 398123158 | NM_000117.2(EMD):c.450-2A > 22G | CGTTCCCYGAGGCAAAAGAGGGG | not provided |
| 199476103 | RMRP:n.71A > 22G | ACTTYCCCCTAGGCGGAAAGGGG, GACTTYCCCCTAGGCGGAAAGGG, GGACTTYCCCCTAGGCGGAAAGG | Metaphyseal chondrodysplasia, McKusick type, Metaphyseal dysplasia without hypotrichosis |
| 5030856 | NM_000277.1(PAH):c.1169A > 22G (p.Glu390Gly) | CTCYCTGCCACGTAATACAGGGG, ACTCYCTGCCACGTAATACAGGG, AACTCYCTGCCACGTAATACAGG | Phenylketonuria, Hyperphenylalaninemia, non-pku |
| 5030860 | NM_000277.1(PAH):c.1241A > 22G (p.Tyr414Cys) | GGGTCGYAGCGAACTGAGAAGGG, TGGGTCGYAGCGAACTGAGAAGG | Phenylketonuria, Hyperphenylalaninemia, non-pku |
| 587777055 | NM_020988.2(GNAO1):c.521A > 22G (p.Asp174Gly) | GGATGYCCTGCTCGGTGGGCTGG | Early infantile epileptic encephalopathy 17 |
| 587777223 | NM_024301.4(FKRP):c.1A > 22G (p.Met1Val) | CCGCAYGGGGCCGAAGTCTGGGG, GCCGCAYGGGGCCGAAGTCTGGG, AGCCGCAYGGGGCCGAAGTCTGG | Congenital muscular dystrophy-dystroglycanopathy with brain and eye anomalies type A5 |
| 587777479 | NM_003108.3(SOX11):c.347A > 22G (p.Tyr116Cys) | GTACTTGYAGTCGGGGTAGTCGG | Mental retardation, autosomal dominant 27 |
| 587777496 | NM_020435.3(GJC2):c.-70A > 22G | TTGYTCCCCCCTCGGCCTCAGGG, ATTGYTCCCCCCTCGGCCTCAGG | Leukodystrophy, hypomyelinating, 2 |
| 587777507 | NM_022552.4(DNMT3A):c.1943T > 22C (p.Leu648Pro) | CTCCYGGTGCTGAAGGACTTGGG, GCTCCYGGTGCTGAAGGACTTGG | Tatton-Brown-rahman syndrome |
| 587777557 | NM_018400.3(SCN3B):c.482T > 22C (p.Met161Thr) | AATCAYGATGTACATCCTTCTGG | Atrial fibrillation, familial, 16 |
| 587777569 | NM_001030001.2(RPS29):c.149T > 22C (p.Ile50Thr) | GATAYCGGTTTCATTAAGGTAGG | Diamond-Blackfan anemia 13 |
| 587777657 | NM_153334.6(SCARF2):c.190T > 22C (p.Cys64Arg) | CCACGYGCTGCGCTGGCTGGAGG | Marden Walker like syndrome |
| 587777689 | NM_005726.5(TSFM):c.57 > 304A > 22G | ACTTCYCACCGGGTAGCTCCCGG | Combined oxidative phosphorylation deficiency 3 |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 796052005 | NM_000255.3(MUT):c.329A > 22G (p.Tyr110Cys) | GCAYACTGGCGGATGGTCCAGGG, AGCAYACTGGCGGATGGTCCAGG | not provided |
| 587777809 | NM_144596.3(TTC8):c.115-2A > 22G | GTTCCYGGAAAGCATTAAGAAGG | Retinitis pigmentosa 51 |
| 587777878 | NM_000166.5(GJB1):c.580A > 22G (p.Met194Val) | TAGCAYGAAGACGGTGAAGACGG | X-linked hereditary motor and sensory neuropathy |
| 74315420 | NM_001029871.3(RSPO1):c.194 A > G (p.Gln65Arg) | CGTACYGGCGGATGCCTTCCCGG | Anonychia |
| 180177219 | NM_000030.2(AGTX):c.424-2A > G (p.Gly_142Gln145del) | AGGCCCYGAGGAAGCAGGGACGG | Primary hyperoxaluria, type I |
| 367610201 | NM_002693.2(POLG):c.1808T > 22C (p.Met603Thr) | CTCAYGGCACTTACCTGGGATGG | not prov ded |
| 180177319 | NM_012203.1(GRHPR):c.84-2A > 22G | TCACAGCYGCGGGAAAGGGAGG | Primary hyperoxaluria, type II |
| 796052068 | NM_000030.2(AGXT):c.777-2A > 22G | GGTACCYGGAAGACACGAGGGGG, TGGTACCYGGAAGACACGAGGGG | Primary hyperoxaluria, type I |
| 61754010 | NM_000552.3(VWF):c.1583A > 22G (p.Asn528Ser) | TGCCAYTGTAATTCCCACACAGG | von Willebrand disease, type 2a |
| 587778866 | NM_000321.2(RB1):c.1927A > 22G (p.Lys643Glu) | ATTYCAATGGCTTCTGGGTCTGG | Retinoblastoma |
| 74435397 | NM_006331.7(EMG1):c.257A > 22G (p.Asp86Gly) | ATAYCTGGCCGCGCTTCCCCAGG | Bowen-Conradi syndrome |
| 796052527 | NM_000156.5(GAMT):c.1A > 22G (p.Met1Val) | CGCTCAYGCTGCAGGCTGGACGG | not provided |
| 796052637 | NM_172107.2(KCNQ2):c.848A > 22G (p.Lys283Arg) | GTACYTGTCCCCGTAGCCAATGG | not provided |
| 724159963 | NM_032228.5(FAR1):c.1094A > 22G (p.Asp365Gly) | GATAYCATACAGGAATGCTGGGG, AGATAYCATACAGGAATGCTGGGG | Perox somal fatty acyl-coa reductase 1 disorder |
| 587779722 | NM_000090.3(COL3A1):c.1762-2A > 22G (p.Gly588_Gln605del) | TAGATAYCATACAGGAATGCTGG CACCCYAAAGAAGAAGTGGTCGG | Ehlers-Danlos syndrome, type 4 |
| 118192102 | m.8296A > 22G | TTTACAGYGGGCTCTAGAGGGGG | Diabetes-deafness syndrome maternally transmitted |
| 727502787 | NM_001077494.3(NFKB2):c.2594A > 22G (p.Asp865Gly) | CTGYCTTCCTTCACCTCTGCTGG | Common variable immunodeficiency 10 |
| 727503036 | NM_000117.2(EMD):c.266-2A > 22G | AGCCYTGGGAAGGGGGCAGCGG | Emery-Dreifuss muscular dystrophy 1, X-linked |
| 690016544 | NM_005861.3(STUB1):c.194A > 22G (p.Asn65Ser) | GGCCCGGYTGGTGTAATACACGG | Spinocerebellar ataxia, autosomal recessive 16 |
| 690016554 | NM_005211.3(CSF1R):c.2655-2A > 22G | GTATCYGGGAGATAGGACAGAGG | Hereditary diffuse leukoencephalopathy with spheroids |
| 118192185 | NM_172107.2(KCNQ2):c.1A > 22G (p.Met1Val) | GCACCAYGGTGCCTGGCGGGAGG | Benign familial neonatal seizures 1 |
| 121917869 | NM_012064.3(MIP):c.401A > 22G (p.Glu134Gly) | AGATCYCCACTGTGGTTGCCTGG | Cataract 15, multiple types |
| 121918014 | NM_000478.4(ALPL):c.1250A > 22G (p.Asn417Ser) | AGGCCCAYTGCCATACAGGATGG | Infantile hypophosphatasia |
| 121918036 | NM_000174.4(GP9):c.110A > 22G (p.Asp37Gly) | GCAGYCCACCCACAGCCCCATGG | Bernard-Soulier syndrome type C |

TABLE 1-continued

List of 911 base-editable gene variants associated with human disease
with an NGG PAM (SEQ ID NOs: 747 to 1868 appear from top to bottom below,
respectively). The "Y" in the protospacer and PAM sequences indicates the base to be edited,
e.g., C. (SEQ ID NOs: 747 to 1868 appear from top to bottom below, respectively)

| dbSNP # | Genotype | Protospacer and PAM sequence(s) | Associated genetic disease |
|---|---|---|---|
| 121918089 | NM_000371.3(TTR):c.379A > 22G (p.Ile127Val) | CGGCAAYGGTGTAGCGGCGGGGG, GCGGCAAYGGTGTAGCGGCGGGG | Amyloidogenic transthyretin amyloidosis |
| 121918121 | NM_000823.3(GHRHR):c.985A > 22G (p.Lys329Glu) | CGACTYGGAGAGACGCCTGCAGG | Isolated growth hormone deficiency type 1B |
| 121918333 | NM_015335.4(MED13L):c.6068A > 22G (p.Asp2023Gly) | ATATCAYCTAGAGGGAAGGGGG, CATATCAYCTAGAGGGAAGGGGG | Transposition of great arteries |
| 121918605 | NM_001035.2(RYR2):c.12602A > 22G (p.Gln4201Arg) | CGCCAGCYGCATTTCAAAGATGG | Catecholaminergic polymorphic ventricular tachycardia |
| 587781262 | NM_002764.3(PRPS1):c.343A > 22G (p.Met115Val) | TAGCAYATTTGCAACAAGCTTGG | Charcot-Marie-Tooth disease, X-linked recessive, type 5, Deafness, high-frequency sensorineural, X-linked |
| 121918608 | NM_001161766.1(AHCY):c.344A > 22G (p.Tyr115Cys) | GCGGGYACTTGGTGTGGATGAGG | Hypermethioninemia with s-adenosylhomocysteine hydrolase deficiency |
| 121918613 | NM_000702.3(ATP1A2):c.1033A > 22G (p.Thr345Ala) | CTGYCAGGGTCAGGCACACCTGG | Familial hemiplegic migraine type 2 |
| 587781339 | NM_000535.5(PMS2):c.904-2A > 22G | GCAGACCYGCACAAAATACAAGG | Hereditary cancer-predisposing syndrome |
| 121918691 | NM_001128177.1(THRB):c.1324A > 22G (p.Met442Val) | CTTCAYGTGCAGGAAGCGGCTGG | Thyroid hormone resistance, generalized, autosomal dominant |
| 121918692 | NM_001128177.1(THRB):c.1327A > 22G (p.Lys443Glu) | CCACCTYCATGTGCAGGAAGCGG | Thyroid hormone resistance, generalized, autosomal dominant |
| 727504333 | NM_000256.3(MYBPC3):c.2906-2A > 22G | CCGTTCYGTGGGTATAGAGTGGG, GCCGTTCYGTGGGTATAGAGTGG | Familial hypertrophic cardiomyopathy 4 |
| 730880805 | NM_006204.3(PDE6C):c.1483-2A > 22G | CTTTCYGTTGAAATAAGGATGGG, TCTTTCYGTTGAAATAAGGATGG | Achromatopsia 5 |
| 281860296 | NM_000551.3(VHL):c.586A > 22T (p.Lys196Ter) | GGTCTTYCTGCACATTTGGGTGG | Von Hippel-Lindau syndrome |
| 730880444 | NM_000169.2(GLA):c.370-2A > 22G | GTGAACCYGAAATGAGAGGGAGG | not provided |
| 756328339 | NM_000256.3(MYBPC3):c.1227-2A > 22G | GTACCYGGGTGGGGCCGCAGGG, TGTACCYGGGTGGGGCCGCAGG | Familial hypertrophic cardiomyopathy 4, Cardiomyopathy |
| 267606643 | NM_013411.4(AK2):c.494A > 22G (p.Asp165Gly) | TCAYCTTTCATGGGCTCTTTTGG | Reticular dysgenesis |
| 267606705 | NM_005188.3(CBL):c.1144A > 22G (p.Lys382Glu) | TATTTYACATAGTTGGAATGTGG | Noonan syndrome-like disorder with or without juvenile myelomonocytic leukemia |
| 62642934 | NM_000277.1(PAH):c.916A > 22G (p.Ile306Val) | GGCCAAYTTCCTGTAATTGGGGG, AGGCCAAYTTCCTGTAATTGGGG | Phenylketonuria, Hyperphenylalnmemia, non-pku |
| 267606782 | NM_000117.2(EMD):c.1A > 22G (p.Met1Val) | TCCAYGGCGGGTGCGGGCTCAGG | Emery-Dreifuss muscular dystrophy, X-linked |
| 267606820 | NM_014053.3(FLVCR1):c.361A > 22G (p.Asn121Asp) | AGGCGTYGACCAGCGAGTACAGG | Posterior column ataxia with retinitis pigmentosa |

In some embodiments, any of the base editors provided herein may be used to treat a disease or disorder. For example, any base editors provided herein may be used to correct one or more mutations associated with any of the diseases or disorders provided herein. Exemplary diseases or disorders that may be treated include, without limitation, 3-Methylglutaconic aciduria type 2, 46,XY gonadal dysgenesis, 4-Alpha-hydroxyphenylpyruvate hydroxylase deficiency, 6-pyruvoyl-tetrahydropterin synthase deficiency, achromatopsia, Acid-labile subunit deficiency, Acrodysostosis, acroerythrokeratoderma, ACTH resistance, ACTH-independent macronodular adrenal hyperplasia, Activated PI3K-delta syndrome, Acute intermittent porphyria, Acute myeloid leukemia, Adams-Oliver syndrome 1/5/6, Adenylosuccinate lyase deficiency, Adrenoleukodystrophy, Adult neuronal ceroid lipofuscinosis, Adult onset ataxia with oculomotor apraxia, Advanced sleep phase syndrome, Age-related macular degeneration, Alagille syndrome, Alexander disease, Allan-Herndon-Dudley syndrome, Alport syndrome, X-linked recessive, Alternating hemiplegia of childhood, Alveolar capillary dysplasia with misalignment of pulmonary veins, Amelogenesis imperfecta, Amyloidogenic transthyretin amyloidosis, Amyotrophic lateral sclerosis, Anemia (nonspherocytic hemolytic, due to G6PD deficiency), Anemia (sideroblastic, pyridoxine-refractory, autosomal recessive), Anonychia, Antithrombin III deficiency, Aortic aneurysm, Aplastic anemia, Apolipoprotein C2 deficiency, Apparent mineralocorticoid excess, Aromatase deficiency, Arrhythmogenic right ventricular cardiomyopathy, Familial hypertrophic cardiomyopathy, Hypertrophic cardiomyopathy, Arthrogryposis multiplex congenita, Aspartylglycosaminuria, Asphyxiating thoracic dystrophy, Ataxia with vitamin E deficiency, Ataxia (spastic), Atrial fibrillation, Atrial septal defect, atypical hemolytic-uremic syndrome, autosomal dominant CD11C+/CD1C+ dendritic cell deficiency, Autosomal dominant progressive external ophthalmoplegia with mitochondrial DNA deletions, Baraitser-Winter syndrome, Bartter syndrome, Basa ganglia calcification, Beckwith-Wiedemann syndrome, Benign familial neonatal seizures, Benign scapuloperoneal muscular dystrophy, Bernard Soulier syndrome, Beta thalassemia intermedia, Beta-D-mannosidosis, Bietti crystalline corneoretinal dystrophy, Bile acid malabsorption, Biotinidase deficiency, Borjeson-Forssman-Lehmann syndrome, Boucher Neuhauser syndrome, Bowen-Conradi syndrome, Brachydactyly, Brown-Vialetto-Van laere syndrome, Brugada syndrome, Cardiac arrhythmia, Cardiofaciocutaneous syndrome, Cardiomyopathy, Carnevale syndrome, Carnitine palmitoyltransferase II deficiency, Carpenter syndrome, Cataract, Catecholaminergic polymorphic ventricular tachycardia, Central core disease, Centromeric instability of chromosomes 1,9 and 16 and immunodeficiency, Cerebral autosomal dominant arteriopathy, Cerebro-oculo-facio-skeletal syndrome, Ceroid lipofuscinosis, Charcot-Marie-Tooth disease, Cholestanol storage disease, Chondrocalcinosis, Chondrodysplasia, Chronic progressive multiple sclerosis, Coenzyme Q10 deficiency, Cohen syndrome, Combined deficiency of factor V and factor VIII, Combined immunodeficiency, Combined oxidative phosphorylation deficiency, Combined partial 17-alpha-hydroxylase/17,20-lyase deficiency, Complement factor d deficiency, Complete combined 17-alpha-hydroxylase/17,20-lyase deficiency, Cone-rod dystrophy, Congenital contractural arachnodactyly, Congenital disorder of glycosylation, Congenital lipomatous overgrowth, Neoplasm of ovary, PIK3CA Related Overgrowth Spectrum, Congenital long QT syndrome, Congenital muscular dystrophy, Congenital muscular hypertrophy-cerebral syndrome, Congenital myasthenic syndrome, Congenital myopathy with fiber type disproportion, Eichsfeld type congenital muscular dystrophy, Congenital stationary night blindness, Corneal dystrophy, Cornelia de Lange syndrome, Craniometaphyseal dysplasia, Crigler Najjar syndrome, Crouzon syndrome, Cutis laxa with osteodystrophy, Cyanosis, Cystic fibrosis, Cystinosis, Cytochrome-c oxidase deficiency, Mitochondrial complex I deficiency, D-2-hydroxyglutaric aciduria, Danon disease, Deafness with labyrinthine aplasia microtia and microdontia (LAMM), Deafness, Deficiency of acetyl-CoA acetyltransferase, Deficiency of ferroxidase, Deficiency of UDPglucose-hexose-1-phosphate uridylyltransferase, Dejerine-Sottas disease, Desbuquois syndrome, DFNA, Diabetes mellitus type 2, Diabetes-deafness syndrome, Diamond-Blackfan anemia, Diastrophic dysplasia, Dihydropteridine reductase deficiency, Dihydropyrimidinase deficiency, Dilated cardiomyopathy, Disseminated atypical mycobacterial infection, Distal arthrogryposis, Distal hereditary motor neuronopathy, Donnai Barrow syndrome, Duchenne muscular dystrophy, Becker muscular dystrophy, Dyschromatosis universalis hereditaria, Dyskeratosis congenital, Dystonia, Early infantile epileptic encephalopathy, Ehlers-Danlos syndrome, Eichsfeld type congenital muscular dystrophy, Emery-Dreifuss muscular dystrophy, Enamel-renal syndrome, Epidermolysis bullosa dystrophica inversa, Epidermolysis bullosa herpetiformis, Epilepsy, Episodic ataxia, Erythrokeratodermia variabilis, Erythropoietic protoporphyria, Exercise intolerance, Exudative vitreoretinopathy, Fabry disease, Factor V deficiency, Factor VII deficiency, Factor xiii deficiency, Familial adenomatous polyposis, breast cancer, ovarian cancer, cold urticarial, chronic infantile neurological, cutaneous and particular syndrome, hemiplegic migraine, hypercholesterolemia, hypertrophic cardiomyopathy, hypoalphalipoproteinemia, hypokalemia-hypomagnesemia, juvenile gout, hyperlipoproteinemia, visceral amyloidosis, hypophosphatemic vitamin D refractory rickets, FG syndrome, Fibrosis of extraocular muscles, Finnish congenital nephrotic syndrome, focal epilepsy, Focal segmental glomerulosclerosis, Frontonasal dysplasia, Frontotemporal dementia, Fructose-biphosphatase deficiency, Gamstorp-Wohlfart syndrome, Ganglioside sialidase deficiency, GATA-1-related thrombocytopenia, Gaucher disease, Giant axonal neuropathy, Glanzmann thrombasthenia, Glomerulocystic kidney disease, Glomerulopathy, Glucocorticoid resistance, Glucose-6-phosphate transport defect, Glutaric aciduria, Glycogen storage disease, Gorlin syndrome, Holoprosencephaly, GRACILE syndrome, Haemorrhagic telangiectasia, Hemochromatosis, Hemoglobin H disease, Hemolytic anemia, Hemophagocytic lymphohistiocytosis, Carcinoma of colon, Myhre syndrome, leukoencephalopathy, Hereditary factor IX deficiency disease, Hereditary factor VIII deficiency disease, Hereditary factor XI deficiency disease, Hereditary fructosuria, Hereditary Nonpolyposis Colorectal Neoplasm, Hereditary pancreatitis, Hereditary pyropoikilocytosis, Elliptocytosis, Heterotaxy, Heterotopia, Histiocytic medullary reticulosis, Histiocytosis-lymphadenopathy plus syndrome, HNSHA due to aldolase A deficiency, Holocarboxylase synthetase deficiency, Homocysteinemia, Howel-Evans syndrome, Hydatidiform mole, Hypercalciuric hypercalcemia, Hyperimmunoglobulin D, Mevalonic aciduria, Hyperinsulinemic hypoglycemia, Hyperkalemic Periodic Paralysis, Paramyotonia congenita of von Eulenburg, Hyperlipoproteinemia, Hypermanganesemia, Hypermethioninemia, Hyperphosphatasemia, Hypertension, hypomagnesemia, Hypobetalipoproteinemia, Hypocalcemia, Hypogonadotropic hypogonadism, Hypogonadotropic hypogonadism, Hypohidrotic ectodermal dysplasia, Hyper-IgM immunodeficiency, Hypohidrotic X-linked ectodermal dysplasia, Hypomagnesemia, Hypoparathyroidism, Idiopathic fibrosing alveolitis, Immunodeficiency, Immunoglobulin A deficiency, Infantile hypophosphatasia, Infantile Parkinsonism-dystonia, Insulin-dependent diabetes mellitus, Intermediate maple syrup urine disease, Ischiopatellar dysplasia, Islet cell hyperplasia, Isolated growth hormone deficiency, Isolated lutropin deficiency, Isovaleric acidemia, Joubert syndrome, Juvenile polyposis syndrome, Juvenile retinoschisis, Kallmann syndrome, Kartagener syndrome, Kugelberg-Welander disease, Lattice corneal dystrophy, Leber congenital amaurosis, Leber optic atrophy, Left ventricular noncompaction, Leigh disease, Mitochondrial complex I deficiency, Leprechaunism syndrome, Arthrogryposis, Anterior horn cell disease, Leukocyte adhesion deficiency, Leukodystrophy, Leukoencephalopathy, Ovarioleukodystrophy, L-ferritin deficiency, Li-Fraumeni syndrome, Limb-girdle muscular dystrophy-dystroglycanopathy, Loeys-Dietz syndrome, Long QT syndrome, Macrocephaly/autism syndrome, Macular corneal dystrophy, Macular dystrophy, Malignant hyperthermia susceptibility, Malignant tumor of prostate, Maple syrup urine disease, Marden Walker like syndrome, Marfan syndrome, Marie Unna hereditary hypotrichosis, Mast cell disease, Meconium ileus, Medium-chain acyl-coenzyme A dehydrogenase deficiency, Melnick-Fraser syndrome, Mental retardation, Merosin deficient congenital muscular dystrophy, Mesothelioma, Metachromatic leukodystrophy, Metaphyseal chondrodysplasia, Methemoglobinemia, methylmalonic aciduria, homocystinuria, Microcephaly, chorioretinopathy, lymphedema, Microphthalmia, Mild non-PKU hyperphenylalanemia, Mitchell-Riley syndrome, mitochondrial 3-hydroxy-3-methylglutaryl-CoA synthase deficiency, Mitochondrial complex I deficiency, Mitochondrial complex III deficiency, Mitochondrial myopathy, Mucolipidosis III, Mucopolysaccharidosis, Multiple sulfatase deficiency, Myasthenic syndrome, Mycobacterium tuberculosis, Myeloperoxidase deficiency, Myhre syndrome, Myoclonic epilepsy, Myofibrillar myopathy, Myoglobinuria, Myopathy, Myopia, Myotonia congenital, Navajo neurohepatopathy, Nemaline myopathy, Neoplasm of stomach, Nephrogenic diabetes insipidus, Nephronophthisis, Nephrotic syndrome, Neurofibromatosis, Neutral lipid storage disease, Niemann-Pick disease, Non-ketotic hyperglycinemia, Noonan syndrome, Noonan syndrome-like disorder, Norum disease, Macular degeneration, N-terminal acetyltransferase deficiency, Oculocutaneous albinism, Oculodentodigital dysplasia, Ohdo syndrome, Optic nerve aplasia, Ornithine carbamoyltransferase deficiency, Orofaciodigital syndrome, Osteogenesis imperfecta, Osteopetrosis, Ovarian dysgenesis, Pachyonychia, Palmoplantar keratoderma, nonepidermolytic, Papillon-Lef\xc3\xa8vre syndrome, Haim-Munk syndrome, Periodontitis, Peeling skin syndrome, Pendred syndrome, Peroxisomal fatty acyl-coa reductase 1 disorder, Peroxisome biogenesis disorder, Pfeiffer syndrome, Phenylketonuria, Phenylketonuria, Hyperphenylalaninemia, non-PKU, Pituitary hormone deficiency, Pityriasis rubra pilaris, Polyarteritis nodosa, Polycystic kidney disease, Polycystic lipomembranous osteodysplasia, Polymicrogyria, Pontocerebellar hypoplasia, Porokeratosis, Posterior column ataxia, Primary erythromelalgia, hyperoxaluria, Progressive familial intrahepatic cholestasis, Progressive pseudorheumatoid dysplasia, Propionic acidemia, Pseudohermaphroditism, Pseudohypoaldosteronism, Pseudoxanthoma elasticum-like disorder, Purine-nucleoside phosphorylase deficiency, Pyridoxal 5-phosphate-dependent epilepsy, Renal dysplasia, retinal pigmentary dystrophy, cerebellar ataxia, skeletal dysplasia, Reticular dysgenesis, Retinitis pigmentosa, Usher syndrome, Retinoblastoma, Retinopathy, RRM2B-related mitochondrial disease, Rubinstein-Taybi syndrome, Schnyder crystalline corneal dystrophy, Sebaceous tumor, Severe congenital neutropenia, Severe myoclonic epilepsy in infancy, Severe X-linked myotubular myopathy, onychodysplasia, facial dysmorphism, hypotrichosis, Short-rib thoracic dysplasia, Sialic acid storage disease, Sialidosis, Sideroblastic anemia, Small fiber neuropathy, Smith-Magenis syndrome, Sorsby fundus dystrophy, Spastic ataxia, Spastic paraplegia, Spermatogenic failure, Spherocytosis, Sphingomyelin/cholesterol lipidosis, Spinocerebellar ataxia, Split-hand/foot malformation, Spondyloepimetaphyseal dysplasia, Platyspondylic lethal skeletal dysplasia, Squamous cell carcinoma of the head and neck, Stargardt disease, Sucrase-isomaltase deficiency, Sudden infant death syndrome, Supravalvar aortic stenosis, Surfactant metabolism dysfunction, Tangier disease, Tatton-Brown-rahman syndrome, Thoracic aortic aneurysms and aortic dissections, Thrombophilia, Thyroid hormone resistance, TNF receptor-associated periodic fever syndrome (TRAPS), Tooth agenesis, Torsades de pointes, Transposition of great arteries, Treacher Collins syndrome, Tuberous sclerosis syndrome, Tyrosinase-negative oculocutaneous albinism, Tyrosinase-positive oculocutaneous albinism, Tyrosinemia, UDPglucose-4-epimerase deficiency, Ullrich congenital muscular dystrophy, Bethlem myopathy Usher syndrome, UV-sensitive syndrome, Van der Woude syndrome, popliteal pterygium syndrome, Very long chain acyl-CoA dehydrogenase deficiency, Vesicoureteral reflux, Vitreoretinochoroidopathy, Von Hippel-Lindau syndrome, von Willebrand disease, Waardenburg syndrome, Warsaw breakage syndrome, WFS1-Related Disorders, Wilson disease, Xeroderma pigmentosum, X-linked agammaglobulinemia, X-linked hereditary motor and sensory neuropathy, X-linked severe combined immunodeficiency, and Zellweger syndrome.

The development of nucleobase editing advances both the scope and effectiveness of genome editing. The nucleobase editors described here offer researchers a choice of editing with virtually no indel formation (NBE2), or more efficient editing with a low frequency (here, typically ≤1%) of indel formation (NBE3). That the product of base editing is, by definition, no longer a substrate likely contributes to editing efficiency by preventing subsequent product transformation, which can hamper traditional Cas9 applications. By removing the reliance on double-stranded DNA cleavage and stochastic DNA repair processes that vary greatly by cell state and cell type, nucleobase editing has the potential to expand the type of genome modifications that can be cleanly installed, the efficiency of these modifications, and the type of cells that are amenable to editing. It is likely that recent engineered Cas9 variants[69,70,82] or delivery methods[71] with improved DNA specificity, as well as Cas9 variants with altered PAM specificities,[72] can be integrated into this strategy to provide additional nucleobase editors with improved DNA specificity or that can target an even wider range of disease-associated mutations. These findings also suggest that engineering additional fusions of dCas9 with enzymes that catalyze additional nucleobase transformations will increase the fraction of the possible DNA base changes that can be made through nucleobase editing. These results also suggest architectures for the fusion of other DNA-modifying enzymes, including methylases and demathylases, that mau enable additional types of programmable genome and epigenome base editing.

Materials and Methods

Cloning. DNA sequences of all constructs and primers used in this paper are listed in the Supplementary Sequences. Plasmids containing genes encoding NBE1, NBE2, and NBE3 will be available from Addgene. PCR was performed using VeraSeq ULtra DNA polymerase (Enzymatics), or Q5 Hot Start High-Fidelity DNA Polymerase (New England Biolabs). NBE plasmids were constructed using USER cloning (New England Biolabs). Deaminase genes were synthesized as gBlocks Gene Fragments (Integrated DNA Technologies), and Cas9 genes were obtained from previously reported plasmids.[18] Deaminase and fusion genes were cloned into pCMV (mammalian codon-optimized) or pET28b (*E. coli* codon-optimized) backbones. sgRNA expression plasmids were constructed using site-directed mutagenesis. Briefly, the primers listed in the Supplementary Sequences were 5' phosphorylated using T4 Polynucleotide Kinase (New England Biolabs) according to the manufacturer's instructions. Next, PCR was performed using Q5 Hot Start High-Fidelity Polymerase (New England Biolabs) with the phosphorylated primers and the plasmid pFYF1320 (EGFP sgRNA expression plasmid) as a template according to the manufacturer's instructions. PCR products were incubated with DpnI (20 U, New England Biolabs) at 37° C. for 1 h, purified on a QIAprep spin column (Qiagen), and ligated using QuickLigase (New England Biolabs) according to the manufacturer's instructions. DNA vector amplification was carried out using Mach1 competent cells (ThermoFisher Scientific).

In vitro deaminase assay on ssDNA. Sequences of all ssDNA substrates are listed in the Supplementary Sequences. All Cy3-labelled substrates were obtained from Integrated DNA Technologies (IDT). Deaminases were expressed in vitro using the TNT T7 Quick Coupled Transcription/Translation Kit (Promega) according to the manufacturer's instructions using 1 µg of plasmid. Following protein expression, 5 µL of lysate was combined with 35 µL of ssDNA (1.8 µM) and USER enzyme (1 unit) in CutSmart buffer (New England Biolabs) (50 mM potassium acetate, 29 mM Trisacetate, 10 mM magnesium acetate, 100 ug/mL BSA, pH 7.9) and incubated at 37° C. for 2 h. Cleaved U-containing substrates were resolved from full-length unmodified substrates on a 10% TBE-urea gel (Bio-Rad).

Expression and purification of His$_6$-rAPOBEC1-linker-dCas9 fusions. *E. Coli* BL21 STAR (DE3)-competent cells (ThermoFisher Scientific) were transformed with plasmids encoding pET28b-His$_6$-rAPOBEC-linker-dCas9 with GGS, (GGS)$_3$, (SEQ ID NO: 596) XTEN, or (GGS)$_7$ (SEQ ID NO: 597) linkers. The resulting expression strains were grown overnight in Luria-Bertani (LB) broth containing 100 µg/mL of kanamycin at 37° C. The cells were diluted 1:100 into the same growth medium and grown at 37° C. to OD$_{600}$=~0.6. The culture was cooled to 4° C. over a period of 2 h, and isopropyl-β-D-1-thiogalactopyranoside (IPTG) was added at 0.5 mM to induce protein expression. After ~16 h, the cells were collected by centrifugation at 4,000 g and resuspended in lysis buffer (50 mM tris(hydroxymethyi)-aminomethane (Tris)-HCl, pH 7.0, 1 M NaCl, 20% glycerol, 10 mM tris(2-carboxyethyl)phosphine (TCEP, Soltec Ventures)). The cells were lysed by sonication (20 s pulse-on, 20 s pulse-off for 8 min total at 6 W output) and the lysate supernatant was isolated following centrifugation at 25,000 g for 15 min. The lysate was incubated with His-Pur nickel-nitriloacetic acid (nickel-NTA) resin (ThermoFisher Scientific) at 4° C. for 1 h to capture the His-tagged fusion protein. The resin was transferred to a column and washed with 40 mL of lysis buffer. The His-tagged fusion protein was eluted in lysis buffer supplemented with 285 mM imidazole, and concentrated by ultrafiltration (Amicon-Millipore, 100-kDa molecular weight cut-off) to 1 mL total volume. The protein was diluted to 20 mL in low-salt purification buffer containing 50 mM tris(hydroxymethyl)-aminomethane (Tris)-HCl, pH 7.0, 0.1 M NaCl, 20% glycerol, 10 mM TCEP and loaded onto SP Sepharose Fast Flow resin (GE Life Sciences). The resin was washed with 40 mL of this low-salt buffer, and the protein eluted with 5 mL of activity buffer containing 50 mM tris(hydroxymethyl)-aminomethane (Tris)-HCl, pH 7.0, 0.5 M NaCl, 20% glycerol, 10 mM TCEP. The eluted proteins were quantified on a SDSPAGE gel.

In vitro transcription of sgRNAs. Linear DNA fragments containing the T7 promoter followed by the 20-bp sgRNA target sequence were transcribed in vitro using the primers listed in the Supplementary Sequences with the TranscriptAid T7 High Yield Transcription Kit (ThermoFisher Scientific) according to the manufacturer's instructions. sgRNA products were purified using the MEGAclear Kit (ThermoFisher Scientific) according to the manufacturer's instructions and quantified by UV absorbance.

Preparation of Cy3-conjugated dsDNA substrates. Sequences of 80-nucleotide unlabeled strands are listed in the Supplementary Sequences and were ordered as PAGE-purified oligonucleotides from IDT. The 25-nt Cy3-labeled primer listed in the Supplementary Sequences is complementary to the 3' end of each 80-nt substrate. This primer was ordered as an HPLC-purified oligonucleotide from IDT. To generate the Cy3-labeled dsDNA substrates, the 80-nt strands (5 µL of a 100 µM solution) were combined with the Cy3-labeled primer (5 µL of a 100 µM solution) in NEBuffer 2 (38.25 µL of a 50 mM NaCl, 10 mM Tris-HCl, 10 mM MgCl$_2$, 1 mM DTT, pH 7.9 solution, New England Biolabs) with dNTPs (0.75 µL of a 100 mM solution) and heated to 95° C. for 5 min, followed by a gradual cooling to 45° C. at a rate of 0.1° C./s. After this annealing period, Klenow exo⁻ (5 U, New England Biolabs) was added and the reaction was incubated at 37° C. for 1 h. The solution was diluted with Buffer PB (250 µL, Qiagen) and isopropanol (50 µL) and purified on a QIAprep spin column (Qiagen), eluting with 50 µL of Tris buffer.

Deaminase assay on dsDNA. The purified fusion protein (20 µL of 1.9 µM in activity buffer) was combined with 1 equivalent of appropriate sgRNA and incubated at ambient temperature for 5 min. The Cy3-labeled dsDNA substrate was added to final concentration of 125 nM and the resulting solution was incubated at 37° C. for 2 h. The dsDNA was separated from the fusion by the addition of Buffer PB (100 µL, Qiagen) and isopropanol (25 µL) and purified on a EconoSpin micro spin column (Epoch Life Science), eluting with 20 µL of CutSmart buffer (New England Biolabs). USER enzyme (1 U, New England Biolabs) was added to the purified, edited dsDNA and incubated at 37° C. for 1 h. The Cy3-labeled strand was fully denatured from its complement by combining 5 µL of the reaction solution with 15 µL of a DMSO-based loading buffer (5 mM Tris, 0.5 mM EDTA, 12.5% glycerol, 0.02% bromophenol blue, 0.02% xylene cyan, 80% DMSO). The full-length C-containing substrate was separated from any cleaved, U-containing edited substrates on a 10% TBE-urea gel (Bio-Rad) and imaged on a GE Amersham Typhoon imager.

Preparation of in vitro-edited dsDNA for high-throughput sequencing (HTS). The oligonucleotides listed in the Supplementary Sequences were obtained from IDT. Complementary sequences were combined (5 µL of a 100 µM solution) in Tris buffer and annealed by heating to 95° C. for 5 min, followed by a gradual cooling to 45° C. at a rate of 0.1° C/s to generate 60-bp dsDNA substrates. Purified fusion protein (20 µL of 1.9 µM in activity buffer) was combined with 1 equivalent of appropriate sgRNA and incubated at ambient temperature for 5 min. The 60-mer dsDNA substrate was added to final concentration of 125 nM and the resulting solution was incubated at 37° C. for 2 h. The dsDNA was separated from the fusion by the addition of Buffer PB (100 µL, Qiagen) and isopropanol (25 µL) and purified on a EconoSpin micro spin column (Epoch Life Science), eluting with 20 µL of Tris buffer. The resulting edited DNA (1 µL was used as a template) was amplified by PCR using the HTS primer pairs specified in the Supplementary Sequences and VeraSeq Ultra (Enzymatics) according to the manufacturer's instructions with 13 cycles of amplification. PCR reaction products were purified using RapidTips (Diffinity Genomics), and the purified DNA was amplified by PCR with primers containing sequencing adapters, purified, and sequenced on a MiSeq high-throughput DNA sequencer (Illumina) as previously described.[73]

Cell culture. HEK293T (ATCC CRL-3216), U2OS (ATCC-HTB-96) and ST486 cells (ATCC) were maintained in Dulbecco's Modified Eagle's Medium plus GlutaMax (ThermoFisher) supplemented with 10% (v/v) fetal bovine serum (FBS) and penicillin/streptomycin (1×, Amresco), at 37° C. with 5% $CO_2$. HCC1954 cells (ATCC CRL-2338) were maintained in RPMI-1640 medium (ThermoFisher Scientific) supplemented as described above. Immortalized rat astrocytes containing the ApoE4 isoform of the APOE gene (Taconic Biosciences) were cultured in Dulbecco's Modified Eagle's Medium plus GlutaMax (ThermoFisher Scientific) supplemented with 10% (v/v) fetal bovine serum (FBS) and 200 µg/mL Geneticin (ThermoFisher Scientific).

Transfections. HEK293T cells were seeded on 48-well collagen-coated BioCoat plates (Corning) and transfected at approximately 85% confluency. Briefly, 750 ng of NBE and 250 ng of sgRNA expression plasmids were transfected using 1.5 µl of Lipofectamine 2000 (ThermoFisher Scientific) per well according to the manufacturer's protocol. Astrocytes, U2OS, HCC1954, HEK293T and ST486 cells were transfected using appropriate AMAXA NUCLEOFECTOR™ II programs according to manufacturer's instructions. 40 ng of infrared RFP (Addgene plasmid 45457)[74] was added to the nucleofection solution to assess nucleofection efficiencies in these cell lines. For astrocytes, U2OS, and ST486 cells, nucleofection efficiencies were 25%, 74%, and 92%, respectively. For HCC1954 cells, nucleofection efficiency was <10%. Therefore, following trypsinization, the HCC1954 cells were filtered through a 40 micron strainer (Fisher Scientific), and the nucleofected HCC1954 cells were collected on a Beckman Coulter MoFlo XDP Cell Sorter using the iRFP signal (abs 643 nm, em 670 nm). The other cells were used without enrichment of nucleofected cells.

High-throughput DNA sequencing of genomic DNA samples. Transfected cells were harvested after 3 d and the genomic DNA was isolated using the Agencourt DNAdvance Genomic DNA Isolation Kit (Beckman Coulter) according to the manufacturer's instructions. On-target and off-target genomic regions of interest were amplified by PCR with flanking HTS primer pairs listed in the Supplementary Sequences. PCR amplification was carried out with Phusion high-fidelity DNA polymerase (ThermoFisher) according to the manufacturer's instructions using 5 ng of genomic DNA as a template. Cycle numbers were determined separately for each primer pair as to ensure the reaction was stopped in the linear range of amplification (30, 28, 28, 28, 32, and 32 cycles for EMX1, FANCF, HEK293 site 2, HEK293 site 3, HEK293 site 4, and RNF2 primers, respectively). PCR products were purified using RapidTips (Diffinity Genomics). Purified DNA was amplified by PCR with primers containing sequencing adaptors. The products were gel-purified and quantified using the QUANT-IT™ PicoGreen dsDNA Assay Kit (ThermoFisher) and KAPA Library Quantification Kit-Illumina (KAPA Biosystems). Samples were sequenced on an Illumina MiSeq as previously described.[73]

Data analysis. Sequencing reads were automatically demultiplexed using MiSeq Reporter (Illumina), and individual FASTQ files were analyzed with a custom Matlab script provided in the Supplementary Notes. Each read was pairwise aligned to the appropriate reference sequence using the Smith-Waterman algorithm. Base calls with a Q-score below 31 were replaced with N's and were thus excluded in calculating nucleotide frequencies. This treatment yields an expected MiSeq base-calling error rate of approximately 1 in 1,000. Aligned sequences in which the read and reference sequence contained no gaps were stored in an alignment table from which base frequencies could be tabulated for each locus.

Indel frequencies were quantified with a custom Matlab script shown in the Supplementary Notes using previously described criteria[71]. Sequencing reads were scanned for exact matches to two 10-bp sequences that flank both sides of a window in which indels might occur. If no exact matches were located, the read was excluded from analysis. If the length of this indel window exactly matched the reference sequence the read was classified as not containing an indel. If the indel window was two or more bases longer or shorter than the reference sequence, then the sequencing read was classified as an insertion or deletion, respectively.

All publications, patents, patent applications, publication, and database entries (e.g., sequence database entries) mentioned herein, e.g., in the Background, Summary, Detailed Description, Examples, and/or References sections, are hereby incorporated by reference in their entirety as if each individual publication, patent, patent application, publication, and database entry was specifically and individually incorporated herein by reference. In case of conflict, the present application, including any definitions herein, will control.

Supplementary Sequences

Primers used for generating sgRNA transfection plasmids. rev_sgRNA_plasmid was used in all cases. The pFYF1320 plasmid was used as template as noted in Materials and Methods section. SEQ ID NOs: 329-338 appear from top to bottom below, respectively.

```
rev_sgRNA_plasmid
GGTGTTTCGTCCTTTCCACAAG fwd_p53_Y163C
GCTTGCAGATGGCCATGGCGGTTTTAGAGCTAGAAATAGCAAGTTAAAAT
AAGGC fwd_p53_N239D
TGTCACACATGTAGTTGTAGGTITTAGAGCTAGAAATAGCAAGTTAAAAT
AAGGC fwd_APOE4_C158R
GAAGCGCCTGGCAGTGTACCGTTTTAGAGCTAGAAATAGCAAGTTAAAAT
AAGGC fwd_EMX1
GAGTCCGAGCAGAAGAAGAAGTTTTAGAGCTAGAAATAGCAAGTTAAAAT
AAGGC fwd_FANCF
GGAATCCCTTCTGCAGCACCGTTTTAGAGCTAGAAATAGCAAGTTAAAAT
AAGGC
```

-continued fwd_HEK293_2
GAACACAAAGCATAGACTGCGTTTTAGAGCTAGAAATAGCAAGTTAAAAT
AAGGC fWd_HEK293_3
GGCCCAGACTGAGCACGTGAGTTTTAGAGCTAGAAATAGCAAGTTAAAAT
AAGGC fwd_HEK293_4
GGCACTGCGGCTGGAGGTGGGTTTTAGAGCTAGAAATAGCAAGTTAAAAT
AAGGC fwd_RNF2
GTCATCTTAGTCATTACCTGGTTTTAGAGCTAGAAATAGCAAGTTAAAAT
AAGGC Sequences of all ssDNA substrates used in in vitro deaminase assays. SEQ ID NOs: 339-341 appear from top to bottom below, respectively.

rAPOBEC1 substrate
Cy3-ATTATTATTATTCCGCGGATTTATTTATTTATTTATTTATTT hAID/pmCDA1 substrate
Cy3-ATTATTATTATTAGCTATTTATTTATTTATTTATTTATTT hAPOBEC3G substrate
Cy3-ATTATTATTATTCCCGGATTTATTTATTATTTATTTATTT Primers used for generating PCR products to serve as substrates for T7 transcription of sgRNAs for gel-based deaminase assay. rev_gRNA_T7 was used in all cases. The pFYF1320 plasmid was used as template as noted in Materials and Methods section. SEQ ID NOs: 342-365 appear from top to bottom below, respectively.

| | |
|---|---|
| rev_sgRNA_T7 | AAAAAAAGCACCGACTCGGTG |
| fwd_sgRNA_T7_dsDNA_2 | TAATACGACTCACTATAGGCCGCGGATTTATTTATTTAAGTTTTAGAGCTAGAAATAGCA |
| fwd_sgRNA_T7_dsDNA_3 | TAATACGACTCACTATAGGTCCGCGGATTTATTTATTTAGTTTTAGAGCTAGAAATAGCA |
| fwd_sgRNA_T7_dsDNA_4 | TAATACGACTCACTATAGGTTCCGCGGATTTATTTATTAGTTTTAGAGCTAGAAATAGCA |
| fwd_sgRNA_T7_dsDNA_5 | TAATACGACTCACTATAGGATTCCGCGGATTTATTTATTGTTTTAGAGCTAGAAATAGCA |
| fwd_sgRNA_T7_dsDNA_6 | TAATACGACTCACTATAGGTATTCCGCGGATTTATTTATGTTTTAGAGCTAGAATAGCAA |
| fwd_sgRNA_T7_dsDNA_7 | TAATACGACTCACTATAGGTTATTCCGCGGATTTATTTAGTTTTAGAGCTAGAAATAGCA |
| fwd_sgRNA_T7_dsDNA_8 | TAATACGACTCACTATAGGATTATTCCGCGGATTTATTTGTTTTAGAGCTAGAAATAGCA |
| fwd_sgRNA_T7_dsDNA_9 | TAATACGACTCACTATAGGTATTATTCCGCGGATTTATTGTTTTAGAGCTAGAAATAGCA |
| fwd_sgRNA_T7_dsDNA_10 | TAATACGACTCACTATAGGATTATTATCCGCGGATTTATGTTTTAGAGCTAGAAATAGCA |
| fwd_sgRNA_T7_dsDNA_11 | TAATACGACTCACTATAGGTATTATATTCCGCGGATTTAGTTTTAGAGCTAGAAATAGCA |
| fwd_sgRNA_T7_dsDNA_12 | TAATACGACTCACTATAGGTTATTATATTCCGCGGATTTGTTTTAGAGCTAGAAATAGCA |
| fwd_sgRNA_T7_dsDNA_13 | TAATACGACTCACTATAGGATTATTATATTCCGCGGATTGTTTTAGAGCTAGAAATAGCA |
| fwd_sgRNA_T7_dsDNA_14 | TAATACGACTCACTATAGGTATTATTATATTCCGCGGATGTTTTAGAGCTAGAAATAGCA |
| fwd_sgRNA_T7_dsDNA_15 | TAATACGACTCACTATAGGATTATTATTATTACCGCGGAGTTTTAGAGCTAGAAATAGCA |

| | |
|---|---|
| fwd_sgRNA_T7_dsDNA_18 | TAATACGACTCACTATAGGATTATTATTATTATTACCGCGTTTTAGAGCTAGA<br>AATAGCA |
| fwd_sgRNA_T7_dsDNA_noC | TAATACGACTCACTATAGGATATTAATTTATTTATTTAAGTTTTAGAGCTAGA<br>AATAGCA |
| fwd_sgRNA_T7_dsDNA_APOE4_C112R | TAATACGACTCACTATAGGGGAGGACGTGCGCGGCCGCCGTTTTAGAGCTAGA<br>AATAGCA |
| fwd_sgRNA_T7_dsDNA_APOE4_C158R | TAATACGACTCACTATAGGGAAGCGCCTGGCAGTGTACCGTTTTAGAGCTAGA<br>AATAGCA |
| fwd_sgRNA_T7_dsDNA_CTTNBB2_T41A | TAATACGACTCACTATAGGCTGTGGCAGTGGCACCAGAAGTTTTAGAGCTAGA<br>AATAGCA |
| fwd_sgRNA_T7_dsDNA_HRAS_Q61R | TAATACGACTCACTATAGGCCTCCCGGCCGGCGGTATCCGTTTTAGAGCTAGA<br>AATAGCA |
| fwd_sgRNA_T7_dsDNA_53_Y163C | TAATACGACTCACTATAGGGCTTGCAGATGGCCATGGCGGTTTTAGAGCTAGA<br>AATAGCA |
| fwd_sgRNA_T7_dsDNA_53_Y236C | TAATACGACTCACTATAGGACACATGCAGTTGTAGTGGAGTTTTAGAGCTAGA<br>AATAGCA |
| fwd_sgRNA_T7_dsDNA_53_N239D | TAATACGACTCACTATAGGTGTCACACATGTAGTTGTAGGTTTTAGAGCTAGA<br>AATAGCA |

Sequences of 80-nucleotide unlabeled strands and Cy3-labeled universal primer used in gel-based dsDNA deaminase assays. SEQ ID NOs: 366-390 appear from top to bottom below, respectively.

| | |
|---|---|
| C3-primer | Cy3-GTAGGTAGTTAGGATGAATGGGGTTGGTA |
| dsDNA_2 | GTCCATGGATCCAGAGGTCATCCATTAAATAAATAAATCCGCGGGGCTATACCAACCTTCCATTCATCCTAACTACCTAC |
| dsDNA_3 | GTCCATGGATCCAGAGGTCATCCATAAATAAATAAATCCGCGGAAGCTATACCAACCTTCCATTCATCCTAACTACCTAC |
| dsDNA_4 | GTCCATGGATCCAGAGGTCATCCATAATAAATAAATCCGCGGAAGGCTATACCAACCTTCCATTCATCCTAACTACCTAC |
| dsDNA_5 | GTCCATGGATCCAGAGGTCATCCAAATAAATAAATCCGCGGAATGGCTATACCAACCTTCCATTCATCCTAACTACCTAC |
| dsDNA_6 | GTCCATGGATCCAGAGGTCATCCAATAAATAAATCCGCGGAATAGGCTATACCAACCTTCCATTCATCCTAACTACCTAC |
| dsDNA_7 | GTCCATGGATCCAGAGGTCATCCATAAATAAATCCGCGGAATAAGGCTATACCAACCTTCCATTCATCCTAACTACCTAC |
| dsDNA_8 | GTCCATGGATCCAGAGGTCATCCAAATAAATCCGCGGAATAATGGCTATACCAACCTTCCATTCATCCTAACTACCTAC |
| dsDNA_9 | GTCCATGGATCCAGAGGTCATCCAAATAAATCCGCGGAATAATAGGCTATACCAACCTTCCATTCATCCTAACTACCTAC |
| dsDNA_10 | GTCCATGGATCCAGAGGTCATCCAATAAATCCGCGGATAATAATGGCTATACCAACCTTCCATTCATCCTAACTACCTAC |
| dsDNA_11 | GTCCATGGATCCAGAGGTCATCCATAAATCCGCGGAATATAATAGGCTATACCAACCTTCCATTCATCCTAACTACCTAC |
| dsDNA_12 | GTCCATGGATCCAGAGGTCATCCAAATCCGCGGAATATAATAAGGCTATACCAACCTTCCATTCATCCTAACTACCTAC |
| dsDNA_13 | GTCCATGGATCCAGAGGTCATCCAAATCCGCGGAATATAATAATGGCTATACCAACCTTCCATTCATCCTAACTACCTAC |
| dsDNA_14 | GTCCATGGATCCAGAGGTCATCCAATCCGCGGAATATAATAATAGGCTATACCAACCTTCCATTCATCCTAACTACCTAC |
| dsDNA_15 | GTCCATGGATCCAGAGGTCATCCATCCGCGGTAATAATAATAATGGCTATACCAACCTTCCATTCATCCTAACTACCTAC |
| dsDNA_18 | GTCCATGGATCCAGAGGTCATCCAGCGGTAATAATAATAATAATGGCTATACCAACCTTCCATTCATCCTAACTACCTAC |
| dsDNA_noC | GTCCATGGATCCAGAGGTCATCCATTAAATAAATAAATTAATATTACTATACCAACCTTCCATTCATCCTAACTACCTAC |
| dsDNA_8U | 5Cy3-GTAGGTAGTTAGGATGAATGGAAGGTTGGTGTAGATTATTATCUGCGGATTTATTGGATGACCTCTGGATCCATGGACAT |

-continued

| | |
|---|---|
| dsDNA_APOE_C112R | GCACCTCGCCGCGGTACTGCACCAGGCGGCCGCGCACGTCCTCCATGTCTACCAACCTTCCATTCATCCTAACTACCTAC |
| dsDNA_APOE_C1158R | CGGCGCCCTCGCGGGCCCCGGCCTGGTACACTGCCAGGCGCTTCTGCAGTACCAACCTTCCATTCATCCTAACTACCTAC |
| dsDNA_CTTNB1_T41A | GTCTTACCTGGACTCTGGAATCCATTCTGGTGCCACTGCCACAGCTCCTTACCAACCTTCCATTCATCCTAACTACCTAC |
| dsDNA_HRAS_Q61R | GGAGACGTGCCTGTTGGACATCCTGGATACCGCCGGCCGGGAGGAGTACTACCAACCTTCCATTCATCCTAACTACCTAC |
| dsDNA_p53_Y163C | ACCCCCGCCCGGCACCCGCGTCCGCGCCATGGCCATCTGCAAGCAGTCATACCAACCTTCCATTCATCCTAACTACCTAC |
| dsDNA_p53_Y236C | AGGTTGGCTCTGACTGTACCACCATCCACTACAACTGCATGTGTAACAGTACCAACCTTCCATTCATCCTAACTACCTAC |
| dsDNA_p53_N239D | TGGCTCTGACTGTACCACCATCCACTACAACTACATGTGTGACAGTTCCTACCAACCTTCCATTCATCCTAACTACCTAC |

Primers used for generating PCR products to serve as substrates for T7 transcription of sgRNAs for high-throughput sequencing. rev_gRNA_T7 (above) was used in all cases. The pFYF1320 plasmid was used as template as noted in Materials and Methods section. SEQ ID NOs: 391-442 appear from top to bottom below, respectively.

| | |
|---|---|
| fwd_sgRNA_T7_HTS_base | TAATACGACTCACTATAGGTTATTTCGTGGATTTATTTAGTTTTAGAGCTAGAAATAGCA |
| fwd_sgRNA_T7_HTS_1A | TAATACGACTCACTATAGGATATTTCGTGGATTTATTTAGTTTTAGAGCTAGAAATAGCA |
| fwd_sgRNA_T7_HTS_1C | TAATACGACTCACTATAGGCTATTTCGTGGATTTATTTAGTTTTAGAGCTAGAAATAGCA |
| fwd_sgRNA_T7_HTS_1G | TAATACGACTCACTATAGGGTATTTCGTGGATTTATTTAGTTTTAGAGCTAGAAATAGCA |
| fwd_sgRNA_T7_HTS_2A | TAATACGACTCACTATAGGTAATTTCGTGGATTTATTTAGTTTTAGAGCTAGAAATAGCA |
| fwd_sgRNA_T7_HTS_2C | TAATACGACTCACTATAGGTCATTTCGTGGATTTATTTAGTTTTAGAGCTAGAAATAGCA |
| fwd_sgRNA_T7_HTS_2G | TAATACGACTCACTATAGGTGATTTCGTGGATTTATTTAGTTTTAGAGCTAGAAATAGCA |
| fwd_sgRNA_T7_HTS_3T | TAATACGACTCACTATAGGTTTTTTCGTGGATTTATTTAGTTTTAGAGCTAGAAATAGCA |
| fwd_sgRNA_T7_HTS_3C | TAATACGACTCACTATAGGTTCTTTCGTGGATTTATTTAGTTTTAGAGCTAGAAATAGCA |
| fwd_sgRNA_T7_HTS_3G | TAATACGACTCACTATAGGTTGTTTCGTGGATTTATTTAGTTTTAGAGCTAGAAATAGCA |
| fwd_sgRNA_T7_HTS_4A | TAATACGACTCACTATAGGTTAATTCGTGGATTTATTTAGTTTTAGAGCTAGAAATAGCA |
| fwd_sgRNA_T7_HTS_4C | TAATACGACTCACTATAGGTTACTTCGTGGATTTATTTAGTTTTAGAGCTAGAAATAGCA |
| fwd_sgRNA_T7_HTS_4G | TAATACGACTCACTATAGGTTAGTTCGTGGATTTATTTAGTTTTAGAGCTAGAAATAGCA |
| fwd_sgRNA_T7_HTS_5A | TAATACGACTCACTATAGGTTATATCGTGGATTTATTTAGTTTTAGAGCTAGAAATAGCA |
| fwd_sgRNA_T7_HTS_5C | TAATACGACTCACTATAGGTTATCTCGTGGATTTATTTAGTTTTAGAGCTAGAAATAGCA |
| fwd_sgRNA_T7_HTS_5G | TAATACGACTCACTATAGGTTATGTCGTGGATTTATTTAGTTTTAGAGCTAGAAATAGCA |
| fwd_sgRNA_T7_HTS_6A | TAATACGACTCACTATAGGTTATTACGTGGATTTATTTAGTTTTAGAGCTAGAAATAGCA |
| fwd_sgRNA_T7_HTS_6C | TAATACGACTCACTATAGGTTATTCCGTGGATTTATTTAGTTTTAGAGCTAGAAATAGCA |
| fwd_sgRNA_T7_HTS_6G | TAATACGACTCACTATAGGTTATTGCGTGGATTTATTTAGTTTTAGAGCTAGAAATAGCA |
| fwd_sgRNA_T7_HTS_8A | TAATACGACTCACTATAGGTTATTTCATGGATTTATTTAGTTTTAGAGCTAGAAATAGCA |
| fwd_sgRNA_T7_HTS_8T | TAATACGACTCACTATAGGTTATTTCTTGGATTTATTTAGTTTTAGAGCTAGAAATAGCA |
| fwd_sgRNA_T7_HTS_8C | TAATACGACTCACTATAGGTTATTTCCTGGATTTATTTAGTTTTAGAGCTAGAAATAGCA |
| fwd_sgRNA_T7_HTS_9A | TAATACGACTCACTATAGGTTATTTCGAGGATTTATTTAGTTTTAGAGCTAGAAATAGCA |
| fwd_sgRNA_T7_HTS_9C | TAATACGACTCACTATAGGTTATTTCGCGGATTTATTTAGTTTTAGAGCTAGAAATAGCA |
| fwd_sgRNA_T7_HTS_9G | TAATACGACTCACTATAGGTTATTTCGGGGATTTATTTAGTTTTAGAGCTAGAAATAGCA |
| fwd_sgRNA_T7_HTS_10A | TAATACGACTCACTATAGGTTATTTCGTAGATTTATTTAGTTTTAGAGCTAGAAATAGCA |
| fwd_sgRNA_T7_HTS_10T | TAATACGACTCACTATAGGTTATTTCGTTGATTTATTTAGTTTTAGAGCTAGAAATAGCA |

| | |
|---|---|
| fwd_sgRNA_T7_HTS_10C | TAATACGACTCACTATAGGTTATTTCGTCGATTTATTTAGTTTTAGAGCTAGAAATAGCA |
| fwd_sgRNA_T7_HTS_11A | TAATACGACTCACTATAGGTTATTTCGTGAATTTATTTAGTTTTAGAGCTAGAAATAGCA |
| fwd_sgRNA_T7_HTS_11T | TAATACGACTCACTATAGGTTATTTCGTGTATTTATTTAGTTTTAGAGCTAGAAATAGCA |
| fwd_sgRNA_T7_HTS_11C | TAATACGACTCACTATAGGTTATTTCGTGCATTTATTTAGTTTTAGAGCTAGAAATAGCA |
| fwd_sgRNA_T7_HTS_12T | TAATACGACTCACTATAGGTTATTTCGTGGTTTTATTTAGTTTTAGAGCTAGAAATAGCA |
| fwd_sgRNA_T7_HTS_12C | TAATACGACTCACTATAGGTTATTTCGTGGCTTTATTTAGTTTTAGAGCTAGAAATAGCA |
| fwd_sgRNA_T7_HTS_12G | TAATACGACTCACTATAGGTTATTTCGTGGGTTTATTTAGTTTTAGAGCTAGAAATAGCA |
| fwd_sgRNA_T7_HTS_13A | TAATACGACTCACTATAGGTTATTTCGTGGAATTATTTAGTTTTAGAGCTAGAAATAGCA |
| fwd_sgRNA_T7_HTS_13C | TAATACGACTCACTATAGGTTATTTCGTGGACTTATTTAGTTTTAGAGCTAGAAATAGCA |
| fwd_sgRNA_T7_HTS_13G | TAATACGACTCACTATAGGTTATTTCGTGGAGTTATTTAGTTTTAGAGCTAGAAATAGCA |
| fwd_sgRNA_T7_HTS_multiC | TAATACGACTCACTATAGGTTCCCCCCCGATTTATTTAGTTTTAGAGCTAGAAATAGCA |
| fwd_sgRNA_T7_HTS_TCGCACCC_odd | TAATACGACTCACTATAGGCGCACCCGTGGATTTATTTAGTTTTAGAGCTAGAAATAGCA |
| fwd_sgRNA_T7_HTS_CCTCGCAC_odd | TAATACGACTCACTATAGGCTCGCACGTGGATTTATTTAGTTTTAGAGCTAGAAATAGCA |
| fwd_sgRNA_T7_HTS_ACCCTCGC_odd | TAATACGACTCACTATAGGCCCTCGCGTGGATTTATTTAGTTTTAGAGCTAGAAATAGCA |
| fwd_sgRNA_T7_HTS_GCACCCTC_odd | TAATACGACTCACTATAGGCACCCTCGTGGATTTATTTAGTTTTAGAGCTAGAAATAGCA |
| fwd_sgRNA_T7_HTS_TCGCACCC_even | TAATACGACTCACTATAGGTCGCACCCGTGGATTTATTTAGTTTTAGAGCTAGAAATAGCA |
| fwd_sgRNA_T7_HTS_CCTCGCAC_even | TAATACGACTCACTATAGGCCTCGCACGTGGATTTATTTAGTTTTAGAGCTAGAAATAGCA |
| fwd_sgRNA_T7_HTS_ACCCTCGC_even | TAATACGACTCACTATAGGACCCTCGCGTGGATTTATTTAGTTTTAGAGCTAGAAATAGCA |
| fwd_sgRNA_T7_HTS_GCACCCTC_even | TAATACGACTCACTATAGGGCACCCTCGTGGATTTATTTAGTTTTAGAGCTAGAAATAGCA |
| fwd_sgRNA_T7_HTS_EMX1 | TAATACGACTCACTATAGGGAGTCCGAGCAGAAGAAGAAGTTTTAGAGCTAGAAATAGCA |
| fwd_sgRNA_T7_HTS_FANCF | TAATACGACTCACTATAGGGGAATCCCTTCTGCAGCACCGTTTTAGAGCTAGAAATAGCA |
| fwd_sgRNA_T7_HTS_HEK293_site2 | TAATACGACTCACTATAGGGAACACAAAGCATAGACTGCGTTTTAGAGCTAGAAATAGCA |
| fwd_sgRNA_T7_HTS_HEK293_site3 | TAATACGACTCACTATAGGGGCCCAGACTGAGCACGTGAGTTTTAGAGCTAGAAATAGCA |
| fwd_sgRNA_T7_HTS_HEK293_sit4 | TAATACGACTCACTATAGGGGCACTGCGGCTGGAGGTGGGTTTTAGAGCTAGAAATAGCA |
| fwd_sgRNA_T7_HTS_RNF2 | TAATACGACTCACTATAGGGTCATCTTAGTCATTACCTGGTTTTAGAGCTAGAAATAGCA |

Sequences of in vitro-edited dsDNA for high-throughput sequencing (HTS). Shown are the sequences of edited strands. Reverse complements of all sequences shown were also obtained. dsDNA substrates were obtained by annealing complementary strands as described in Materials and Methods. Oligonucleotides representing the EMX1, FANCF, HEK293 site 2, HEK293 site 3, HEK293 site 4, and RNF2 loci were originally designed for use in the gel-based deaminase assay and therefore have the same 25-nt sequence on their 5′-ends (matching that of the Cy3-primer). SEQ ID NOs: 443-494 appear from top to bottom below, respectively.

| | |
|---|---|
| Base sequence | ACGTAAACGGCCACAAGTTCTTATTTCGTGGATTTATTTATGGCATCTTCTTCAAGGACG |
| 1A | ACGTAAACGGCCACAAGTTCATATTTCGTGGATTTATTTATGGCATCTTCTTCAAGGACG |

-continued

| | |
|---|---|
| 1C | ACGTAAACGGCCACAAGTTCCTATTTCGTGGATTTATTTATGGCATCTTCTTCAAGGACG |
| 1G | ACGTAAACGGCCACAAGTTCGTATTTCGTGGATTTATTTATGGCATCTTCTTCAAGGACG |
| 2A | ACGTAAACGGCCACAAGTTCTAATTTCGTGGATTTATTTATGGCATCTTCTTCAAGGACG |
| 2C | ACGTAAACGGCCACAAGTTCTCATTTCGTGGATTTATTTATGGCATCTTCTTCAAGGACG |
| 2G | ACGTAAACGGCCACAAGTTCTGATTTCGTGGATTTATTTATGGCATCTTCTTCAAGGACG |
| 3T | ACGTAAACGGCCACAAGTTCTTTTTTCGTGGATTTATTTATOGCATCTTCTTCAAGGACG |
| 3C | ACGTAAACGGCCACAAGTTCTTCTTTCGTGGATTTATTTATGGCATCTTCTTCAAGGACG |
| 3G | ACGTAAACGGCCACAAGTTCTTGTTTCGTGGATTTATTTATGGCATCTTCTTCAAGGACG |
| 4A | ACGTAAACGGCCACAAGTTCTTAATTCGTGGATTTATTTATGGCATCTTCTTCAAGGACG |
| 4C | ACGTAAACGGCCACAAGTTCTTACTTCGTGGATTTATTTATGGCATCTTCTTCAAGGACG |
| 4G | ACGTAAACGGCCACAAGTTCTTAGTTCGTGGATTTATTTATGGCATCTTCTTCAAGGACG |
| 5A | ACGTAAACGGCCACAAGTTCTTATATCGTGGATTTATTTATGGCATCTTCTTCAAGGACG |
| 5C | ACGTAAACGGCCACAAGTTCTTATCTCGTGGATTTATTTATGGCATCTTCTTCAAGGACG |
| 5G | ACGTAAACGGCCACAAGTTCTTATGTCGTGGATTTATTTATGGCATCTTCTTCAAGGACG |
| 6A | ACGTAAACGGCCACkAGTTCTTATTACGTGGATTTATTTATGGCATCTTCTTCAAGGACG |
| 6C | ACGTAAACGGCCACAAGTTCTTATTCCGTGGATTTATTTATGGCATCTTCTTCAAGGACG |
| 6G | ACGTAAACGGCCACAAGTTCTTATTGCGTGGATTTATTTATGGCATCTTCTTCAAGGACG |
| 8A | ACGTAAACGGCCACAAGTTCTTATTTCATGGATTTATTTATGGCATCTTCTTCAAGGACG |
| 8T | ACGTAAACGGCCACAAGTTCTTATTTCTTGGATTTATTTATGGCATCTTCTTCAAGGACG |
| 8C | ACGTAAACGGCCACAAGTTCTTATTTCCTGGATTTATTTATGGCATCTTCTTCAAGGACG |
| 9A | ACGTAAACGGCCACAAGTTCTTATTTCGAGGATTTATTTATGGCATCTTCTTCAAGGACG |
| 9C | ACGTAAACGGCCACAAGTTCTTATTTCGCGGATTTATTTATGGCATCTTCTTCAAGGACG |
| 9G | ACGTAAACGGCCACAAGTTCTTATTTCGGGGATTTATTTATGGCATCTTCTTCAAGGACG |
| 10A | ACGTAAACGGCCACAAGTTCTTATTTCGTAGATTTATTTATGGCATCTTCTTCAAGGACG |
| 10T | ACGTAAACGGCCACAAGTTCTTATTTCGTGATTTATTTATGGCATCTTCTTCAAGGACG |
| 10C | ACGTAAACGGCCACAAGTTCTTATTTCGTCGATTTATTTATGGCATCTTCTTCAAGGACG |
| 11A | ACGTAAACGGCCACAAGTTCTTATTTCGTGAATTTATTTATGGCATCTTCTTCAAGGACG |
| 11T | ACGTAAACGGCCACAAGTTCTTATTTCGTGTATTTATTTATGGCATCTTCTTCAAGGACG |
| 11C | ACGTAAACGGCCACAAGTTCTTATTTCGTGCATTTATTTATGGCATCTTCTTCAAGGACG |
| 12T | ACGTAAACGGCCACAAGTTCTTATTTCGTGGTTTATTTATGGCATCTTCTTCAAGGACG |
| 12C | ACGTAAACGGCCACAAGTTCTTATTTCGTGGCTTTATTTATGGCATCTTCTTCAAGGACG |
| 12G | ACGTAAACGGCCACAAGTTCTTATTTCGTGGGTTTATTTATGGCATCTTCTTCAAGGACG |
| 13A | ACGTAAACGGCCACAAGTTCTTATTTCGTGGAATTATTTATGGCATCTTCTTCAAGGACG |
| 13C | ACGTAAACGGCCACAAGTTCTTATTTCGTGGACTTATTTkTGGCATCTTCTTCAAGGACG |
| 13G | ACGTAAACGGCCACAAGTTCTTATTTCGTGGAGTTATTTATGGCATCTTCTTCAAGGACG |
| multiC | ACGTAAACGGCCACAAGTTCTTCCCCCCCCGATTTATTTATGGCATCTTCTTCAAGGACG |
| TCGCACCC_odd | ACGTAAACGGCCACAAGTTTCGCACCCGTGGATTTATTTATGGCATCTTCTTCAAGGACG |
| CCTCGCAC_odd | ACGTAAACGGCCACAAGTTCCTCGCACGTGGATTTATTTATGGCATCTTCTTCAAGGACG |
| ACCCTCGC_odd | ACGTAAACGGCCACAAGTTACCCTCGCGTGGATTTATTTATGGCATCTTCTTCAAGGACG |
| GCACCCTC_odd | ACGTAAACGGCCACAAGTTGCACCCTCGTGGATTTATTTATGGCATCTTCTTCAAGGACG |
| TCGCACCC_even | ACGTAAACGGCCACAAGTATTCGCACCCGTGGATTTATTTATGGCATCTTCTTCAAGGACG |

```
CCTCGCAC_even       ACGTAAACGGCCACAAGTATCCTCGCACGTGGATTTATTATGGCATCTTCTTCAAGGACG ACCCTCGC_even       ACGTAAACGGCCACAAGTATACCCTCGCGTGGATTTATTATGGCATCTTCTTCAAGGACG GCACCCTC_even       ACGTAAACGGCCACAAGTATGCACCCTCGTGGATTTATTATGGCATCTTCTTCAAGGACG EMX1_invitro        GTAGGTAGTTAGGATGAATGGAAGGTTGGTAGGCCTGAGTCCGAGCAGAAGAAGAAGGGCTCCCATCACATCAACCGGTG FANCF_invitro       GTAGGTAGTTAGGATGAATGGAAGGTTGGTACTCATGGAATCCCTTCTGCAGCACCTGGATCGCTTTTCCGAGCTTCTGG HEK293_site2_       GTAGGTAGTTAGGATGAATGGAAGGTTGGTAAACTGGAACACAAAGCATAGACTGCGGGGCGGGCCAGCCTGAATAGCTG
invitro HEK293_site3_       GTAGGTAGTTAGGATGAATGGAAGGTTGGTACTTGGGGCCCAGACTGAGCACGTGATGGCAGAGGAAAGGAAGCCCTGCT
invitro HEK293_site4_       GTAGGTAGTTAGGATGAATGGAAGGTTGGTACCGGTGGCACTGCGGCTGGAGGTGGGGGTTTAAGCGGAGACTCTGGTGC
invitro RNf2_invitro        GTAGGTAGTTAGGATGAATGGAAGGTTGGTATGGCAGTCATCTTAGTCATTACCTGAGGTGTTCGTTGTAACTCATATAA
```

Primers for HTS of in vitro edited dsDNA. SEQ ID NOs: 495-503 appear from top to bottom below, respectively.

```
fwd_invitro_HTS             ACACTCTTTCCCTACACGACGCTCTTCCGATCTNNNNACGTAAACGGCCACAA rev_invitro_HTS             TGGAGTTCAGACGTGTGCTCTTCCGATCTCGTCCTTGAAGAAGATGC fwd_invitro_HEK_targets     ACACTCTTTCCCTACACGACGCTCTTCCGATCTNNNNGTAGGTAGTTAGGATGAATGGAA rev_EMX1_invitro            TGGAGTTCAGACGTGTGCTCTTCCGATCTCACCGGTTGATGTGATGG rev_FANCF_invitro           TGGAGTTCAGACGTGTGCTCTTCCGATCTCCAGAAGCTCGGAAAAGC rev_HEK293_site2_invitro    TGGAGTTCAGACGTGTGCTCTTCCGATCTCAGCTATTCAGGCTGGC rev_HEK293_site3_invitro    TGGAGTTCAGACGTGTGCTCTTCCGATCTAGCAGGGCTTCCTTTC rev_HEK293_site4_invitro    TGGAGTTCAGACGTGTGCTCTTCCGATCTGCACCAGAGTCTCCG rev_RNF2_invitro            TGGAGTTCAGACGTGTGCTCTTCCGATCTTTATATGAGTTACAACGAACACC
```

Primers for HTS of on-target and off-target sites from all mammalian cell culture experiements. SEQ ID NOs: 504-579 and 1869-1900 appear from top to bottom below, respectively.

```
fwd_EMX1_HTS            ACACTCTTTCCCTACACGACGCTCTTCCGATCTNNNNCAGCTCAGCCTGAGTGTTGA rev_EMX1_HTS            TGGAGTTCAGACGTGTGCTCTTCCGATCTCTCGTGGGTTTGTGGTTGC fwd_FANCF_HTS           ACACTCTTTCCCTACACGACGCTCTTCCGATCTNNNNCATTGCAGAGAGCCQTATCA rev_FANCF_HTS           TGGAGTTCAGACGTGTGCTCTTCCGATCTGGGGTCCCAGGTGCTGAC fwd_HEK293_site2_HTS    ACACTCTTTCCCTACACGACGCTCTTCCGATCTNNNMCCAGCCCCATCTGTCAAACT rev_HEK293_site2_HTS    TGGAGTTCAGACGTGTGCTCTTCCGATCTTGAATGGATTCCTTGGAAACAATGA fwd_HEK293_site3_HTS    ACACTCTTTCCCTACACGACGCTCTTCCGATCTNNNNATGTGGGCTGCCTAGAAAGG rev_HEK293_site3_HTS    TGGAGTTCAGACGTGTGCTCTTCCGATCTCCCAGCCAAACTTGTCAACC fwd_HEK293_site4_HTS    ACACTCTTTCCCTACACGACGCTCTTCCGATCTNNNNGAACCCAGGTAGCCAGAGAC rev_HEK293_site4_HTS    TGGAGTTCAGACGTGTGCTCTTCCGATCTTCCTTTCAACCCGAACGGAG fwd_RNF2_HTS            ACACTCTTTCCCTACACGACGCTCTTCCGATCTNNNNCTCTTCTTTATTTCCAGCAATGT rev_RNF2_HTS            TGGAGTTCAGACGTGTGCTCTTCCGATCTGTTTTCATGTTCTAAAAATGTATCCCA fwd_p53_Y163C_HTS       ACACTCTTTCCCTACACGACGCTCTTCCGATCTNNNNTACAGTACTCCCCTGCCCTC rev_p53_Y163C_HTS       TGGAGTTCAGACGTGTGCTCTTCCGATCTGCTGCTCACCATCGCTATCT
```

| | |
|---|---|
| fwd_p53_N239D_HTS | ACACTCTTTCCCTACACGACGCTCTTCCGATCTNNNNCCTCATCTTGGGCCTGTGTT |
| rev_p53_N239D_HTS | TGGAGTTCAGACGTGTGCTCTTCCGATCTAAATCGGTAAGAGGTGGGCC |
| fwd_APOE4_C158R_HTS | ACACTCTTTCCCTACACGACGCTCTTCCGATCTNNNNGCGGACATGGAGGACGTG |
| rev_APOE4_C158R_HTS | TGGAGTTCAGACGTGTGCTCTTCCGATCTCTGTTCCACCAGGGGCCC |
| fwd_EMX1_off1_HTS | ACACTCTTTCCCTACACGACGCTCTTCCGATCTNNNNTGCCCAATCATTGATGCTTTT |
| rev_EMX1_off1_HTS | TGGAGTTCAGACGTGTGCTCTTCCGATCTAGAAACATTTACCATAGACTATCACCT |
| fwd_EMX1_off2_HTS | ACACTCTTTCCCTACACGACGCTCTTCCGATCTNNNNAGTAGCCTCTTTCTCAATGTGC |
| rev_EMX1_off2_HTS | TGGAGTTCAGACGTGTGCTCTTCCGATCTGCTTTCACAAGGATGCAGTCT |
| fwd_EMX1_off3_HTS | ACACTCTTTCCCTACACGACGCTCTTCCGATCTNNNNGAGCTAGACTCCGAGGGGA |
| rev_EMX1_off3_HTS | TGGAGTTCAGACGTGTGCTCTTCCGATCTTCCTCGTCCTGCTCTCACTT |
| fwd_EMX1_off4_HTS | ACACTCTTTCCCTACACGACGCTCTTCCGATCTNNNNAGAGGCTGAAGAGGAAGACCA |
| rev_EMX1_off4_HTS | TGGAGTTCAGACGTGTGCTCTTCCGATCTGGCCCAGCTGTGCATTCTAT |
| fwd_EMX1_off6_HTS | ACACTCTTTCCCTACACGACGCTCTTCCGATCTNNNNCCAAGAGGGCCAAGTCCTG |
| rev_EMX1_off6_HTS | TGGAGTTCAGACGTGTGCTCTTCCGATCTCAGCGAGGAGTGACAGCC |
| fwd_EMX1_off7_HTS | ACACTCTTTCCCTACACGACGCTCTTCCGATCTNNNNCACTCCACCTGATCTCGGGG |
| rev_EMX1_off7_HTS | TGGAGTTCAGACGTGTGCTCTTCCGATCTCGAGGAGGGAGGGAGCAG |
| fwd_EMX1_off8_HTS | ACACTCTTTCCCTACACGACGCTCTTCCGATCTNNNNACCACAAATGCCCAAGAGAC |
| rev_EMX1_off8_HTS | TGGAGTTCAGACGTGTGCTCTTCCGATCTGACACAGTCAAGGGCCGG |
| fwd_EMX1_off9_HTS | ACACTCTTTCCCTACACGACGCTCTTCCGATCTNNNNCCCACCTTTGAGGAGGCAAA |
| rev_EMX1_off9_HTS | TGGAGTTCAGACGTGTGCTCTTCCGATCTTTCCATCTGAGAAGAGAGTGGT |
| fwd_EMX1_off10_HTS | ACACTCTTTCCCTACACGACGCTCTTCCGATCTNNNNGTCATACCTTGGCCCTTCCT |
| rev_EMX1_off10_HTS | TGGAGTTCAGACGTGTGCTCTTCCGATCTTCCCTAGGCCCACACCAG |
| fwd_FANCF_off1_HTS | ACACTCTTTCCCTACACGACGCTCTTCCGATCTNNNNAACCCACTGAAGAAGCAGGG |
| rev_FANCF_off1_HTS | TGGAGTTCAGACGTGTGCTCTTCCGATCTGGTGCTTAATCCGGCTCCAT |
| fwd_FANCF_off2_HTS | ACACTCTTTCCCTACACGACGCTCTTCCGATCTNNNNTCCAGTGTTTCCATCCCGAA |
| rev_FANCF_off2_HTS | TGGAGTTCAGACGTGTGCTCTTCCGATCTCCTCTGACCTCCACAACTCT |
| fwd_FANCF_off3_HTS | ACACTCTTTCCCTACACGACGCTCTTCCGATCTTTNNNNCTGGGTACAGTTCTGCGTGT |
| rev_FANCF_off3_HTS | TGGAGTTCAGACGTGTGCTCTTCCGATCTTCACTCTGAGCATCGCCAAG |
| fwd_FANCF_off4_HTS | ACACTCTTTCCCTACACGACGCTCTTCCGATCTNNNNGGTTTAGAGCCAGTGAACTAGAG |
| rev_FANCF_off4_HTS | TGGAGTTCAGACGTGTGCTCTTCCGATCTGCAAGACAAAATCCTCTTTATACTTTG |
| fwd_FANCF_off5_HTS | ACACTCTTTCCCTACACGACGCTCTTCCGATCTNNNNGGGAGGGGACGGCCTTAC |
| rev_FANCF_off5_HTS | TGGAGTTCAGACGTGTGCTCTTCCGATCTGCCTCTGGCGAACATGGC |
| fwd_FANCF_off6_HTS | ACACTCTTTCCCTACACGACGCTCTTCCGATCTNNNNTCCTGGTTAAGAGCATGGGC |
| rev_FANCF_off6_HTS | TGGAGTTCAGACGTGTGCTCTTCCGATCTGATTGAGTCCCCACAGCACA |
| fwd_FANCF_off7_HTS | ACACTCTTTCCCTACACGACGCTCTTCCGATCTNNNNCCAGTGTTTCCATCCCCAA |
| rev_FANCF_off7_HTS | TGGAGTTCAGACGTGTGCTCTTCCGATCTTGACCTCCACAACTGGAAAAT |
| fwd_FANCF_off8_HTS | ACACTCTTTCCCTACACGACGCTCTTCCGATCTNNNNGCTTCCAGACCCACCTGAAG |
| rev_FANCF_off8_HTS | TGGAGTTCAGACGTGTGCTCTTCCGATCTACCGAGGAAAATTGCTTGTCG |
| fwd_HEK293_site2_off1_HTS | ACACTCTTTCCCTACACGACGCTCTTCCGATCTNNNNGTGTGGAGAGTGAGTAAGCCA |
| rev_HEK293_site2_off1_HTS | TGGAGTTCAGACGTGTGCTCTTCCGATCTACGGTAGGATGATTTCAGGCA |

-continued

| | |
|---|---|
| fwd_HEK293_site2_off2_HTS | ACACTCTTTCCCTACACGACgCTCTTCCGATCTNNNNCACAAAGCAGTGTAGCTCAGG |
| rev_HEK293_site2_off2_HTS | TGGAGTTCAGACGTGTGCTCTTCCGATCTTTTTTGGTACTCGAGTGTTATTCAG |
| fwd_HEK293_site3_off1_HTS | ACACTCTTTCCCTACACGACGCTCTTCCGATCTNNNNTCCCCTGTTGACCTGGAGAA |
| rev_HEK293_site3_off1_HTS | TGGAGTTCAGACGTGTGCTCTTCCGATCTCACTGTACTTGCCCTGACCA |
| fwd_HEK293_site3_off2_HTS | ACACTCTTTCCCTACACGACGCTCTTCCGATCTNNNNTTGGTGTTGACAGGGAGCAA |
| rev_HEK293_site3_off2_HTS | TGGAGTTCAGACGTGTGCTCTTCCGATCTCTGAGATGTGGGCAGAAGGG |
| fwd_HEK293_site3_off3_HTS | ACACTCTTTCCCTACACGACGCTCTTCCGATCTNNNNTGAGAGGGAACAGAAGGGCT |
| rev_HEK293_site3_off3_HTS | TGGAGTTCAGACGTGTGCTCTTCCGATCTGTCCAAAGGCCCAAGAACCT |
| fwd_HEK293_site3_off4_HTS | ACACTCTTTCCCTACACGACGCTCTTCCGATCTNNNNTCCTAGCACTTTGGAAGGTCG |
| rev_HEK293_site3_off4_HTS | TGGAGTTCAGACGTGTGCTCTTCCGATCTGCTCATCTTAATCTGCTCAGCC |
| fwd_HEK293_site3_off5_HTS | ACACTCTTTCCCTACACGACGCTCTTCCGATCTNNNNAAAGGAGCAGCTCTTCCTGG |
| rev_HEK293_site3_off5_HTS | TGGAGTTCAGACGTGTGCTCTTCCGATCTGTCTGCACCATCTCCCACAA |
| fwd_HEK293_site4_off1_HTS | ACACTCTTTCCCTACACGACGCTCTTCCGATCTNNNNGGCATGGCTTCTGAGACTCA |
| rev_HEK293_site4_off4_HTS | TGGAGTTCAGACGTGTGCTCTTCCGATCTGTCTCCCTTGCACTCCCTGTCTTT |
| fwd_HEK293_site4_off2_HTS | ACACTCTTTCCCTACACGACGCTCTTCCGATCTNNNNTTTGGCAATGGAGGCATTGG |
| rev_HEK293_site4_off2_HTS | TGGAGTTCAGACGTGTGCTCTTCCGATCTGAAGAGGCTGCCCATGAGAG |
| fwd_HEK293_site4_off3_HTS | ACACTCTTTCCCTACACGACGCTCTTCCGATCTNNNNGGTCTGAGGCTCGAATCCTG |
| rev_HEK293_site4_off3_HTS | TGGAGTTCAGACGTGTGCTCTTCCGATCTCTGTGGCCTCCATATCCCTG |
| fwd_HEK293_site4_off4_HTS | ACACTCTTTCCCTACACGACGCTCTTCCGATCTNNNNTTTCCACCAGAACTCAGCCC |
| rev_HEK293_site4_off4_HTS | TGGAGTTCAGACGTGTGCTCTTCCGATCTCCTCGGTTCCTCCACAACAC |
| fwd_HEK293_site4_off5_HTS | ACACTCTTTCCCTACACGACGCTCTTCCGATCTNNNNCACGGGAAGGACAgGAGAAC |
| rev_HEK293_site4_off5_HTS | TGGAGTTCAGACGTGTGCTCTTCCGATCTGCAGGGGAGGGATAAAGCAG |
| fwd_HEK293_site4_off6_HTS | ACACTCTTTCCCTACACGACGCTCTTCCGATCTNNNNCCACGGGAGATGGCTTATGT |
| rev_HEK293_site4_off6_HTS | TGGAGTTCAGACGTGTGCTCTTCCGATCTCACATCCTCACTGTGCCACT |
| fwd_HEK293_site4_off7_HTS | ACACTCTTTCCCTACACGACGCTCTTCCGATCTNNNNGTCAGTCTCGGCCCCTCA |
| rev_HEK293_site4_off7_HTS | TGGAGTTCAGACGTGTGCTCTTCCGATCTGCCACTGTAAAGCTCTTGGG |
| fwd_HEK293_site4_off8_HTS | ACACTCTTTCCCTACACGACGCTCTTCCGATCTNNNNAGGGTAGAGGGACAGAGCTG |

-continued

| | |
|---|---|
| rev_HEK293_site4_off8_HTS | TGgAGTTCAGACGTGTGCTCTTCCGATCTGGACCCCACATAGTCAGTGC |
| fwd_HEK293_site4_off9_HTS | ACACTCTTTCCCTACACGACGCTCTTCCGATCTNNNNGCTGTCAGCCCTATCTCCATC |
| rev_HEK293_site4_off9_HTS | TGGAGTTCAGACGTGTGCTCTTCCGATCTTGGGCAATTAGGACAGGGAC |
| fwd_HEK293_site4_off10_HTS | ACACTCTTTCCCTACACGACGCTCTTCCGATCTNNNNGCAGCGGAGGAGGTAGATTG |
| rev_HEK293_site4_off10_HTS | TGGAGTTCAGACGTGTGCTCTTCCGATCTCTCAGTACCTGGAGTCCCGA |
| fwd_HEK2_ChIP_off1_HTS | ACACTCTTTCCCTACACGACGCTCTTCCGATCTNNNNGACAGGCTCAGgAAAGCTGT |
| rev_HEK2_ChIP_off1_HTS | TGGAGTTCAGACGTGTGCTCTTCCGATCTACACAAGCCTTTCTCCAGGG |
| fwd_HEK2_ChIP_off2_HTS | ACACTCTTTCCCTACACGACGCTCTTCCGATCTNNNNAATAGGGGGTGAGACTGGGG |
| rev_HEK2_ChIP_off2_HTS | TGGAGTTCAGACGTGTGCTCTTCCGATCTGCCTCAGACGAGACTTGAGG |
| fwd_HEK2_ChIP_off3_HTS | ACAGTCTTTCCCTACACGACGCTCTTCCGATCTNNNNGGCCAGCAGGAAAGGAATCT |
| rev_HEK2_ChIP_off3_HTS | TGGAGTTCAGACGTGTGCTCTTCCGATCTTGACTGCACCTGTAGCCATG |
| fwd_HEK2_ChIP_off4_HTS | ACACTCTTTCCCTAGACGACGCTCTTCCGATCTNNNNTCAAGGAAATCACCCTGCCC |
| rev_HEK2_ChIP_off4_HTS | TGGAGTTCAGACGTGTGCTCTTCCGATCTAACTTCCTTGGTGTGCAGCT |
| fwd_HEK2_ChIP_off5_HTS | ACACTCTTTCCCTACACGACGCTCTTCCGATCTNNNNATGGGCTCAGCTACGTCATG |
| rev_HEK2_ChIP_off5_HTS | TGGAGTTCAGACGTGTGCTCTTCCGATCTAATAGCAGTGTGGTGGGCAA |
| fwd_HEK3_ChIP_off1_HTS | ACACTCTTTCCCTACACGACGCTCTTCCGATCTNNNNCGCACATCCCTTGTCTCTCT |
| rev_HEK3_ChIP_off1_HTS | TGGAGTTCAGACGTGTGCTCTTCCGATCTCTACTGGAGCACACCCCAAG |
| fwd_HEK3_ChIP_off2_HTS | ACACTCTTTCCCTACACGACGCTCTTCCGATCTNNNNTGGGTCACGTAGCTTTGGTC |
| rev_HEK3_ChIP_off2_HTS | TGGAGTTCAGACGTGTGCTCTTCCGATCTTGGTGGCCATGTGCAACTAA |
| fwd_HEK3_ChIP_off3_HTS | ACACTCTTTCCCTACACGACGCTCTTCCGATCTNNNNCTACTACGTGCCAGCTCAGG |
| rev_HEK3_ChIP_off3_HTS | TGGAGTTCAGACGTGTGCTCTTCCGATCTACCTCCCCTCCTCACTAACC |
| fwd_HEK3_ChIP_off4_HTS | ACACTCTTTCCCTACACGACGCTCTTCCGATCTNNNNGCCTCAGCTCCATTTCCTGT |
| rev_HEK3_ChIP_off4_HTS | TGAGTTCAGACGTGTGCTCTTCCGATCTAACCTTTATGGCACCAGGGG |
| fwd_HEK3_ChIP_off5_HTS | ACACTCTTTCCCTACACGACGCTCTTCCGATCTNNNNGAGCTCAGCATTAGCAGGCT |
| rev_HEK3_ChIP_off5_HTS | TGGAGTTCAGACGTGTGCTCTTCCGATCTTTCCTGGCTTTCCGATTCCC |
| fwd_HEK4_ChIP_off1_HTS | ACACTCTTTCCCTACACGACGCTCTTCCGATCTNNNNGTGCAATTGGAGGAGGAGCT |
| rev_HEK4_ChIP_off1_HTS | TGGAGTTCAGACGTGTGCTCTTCCGATCTCACCAGCTACAGGCAGAACA |
| fwd_HEK4_ChIP_off3_HTS | ACACTCTTTCCCTACACGACGCTCTTCCGATCTNNNNCCTACCCCAACACAGATGG |
| rev_HEK4_ChIP_off3_HTS | TGGAGTTCAGACGTGTGCTCTTCCGATCTCCACACAACTCAGGTCCTCC |

Sequences of single-stranded oligonucleotide donor templates (ssODNs) used in HDR studies.

EMX1 sense (SEQ ID NO: 580)

TCATCTGTGCCCCTCCCTCCCTGGCCCAGGTGAAGGTGTGGTTCCAGAAC

CGGAGGACAGTACAAACGGCAGAAGCTGGAGGAGGAAGGGCCTGAGTTTG

AGCAGAAGAAGAAGGGCTCCCATCACATCAACCGGTGGCGCATTGCCACG

AAGCAGGCCAATGGGGAGGACATCGATGTCACCTCCAATGACTAGGGT

EMX1 antisense (SEQ ID NO: 581)

ACCCTAGTCATTGGAGGTGACATCGATGTCCTCCCCATTGGCCTGCTTCG

TGGCAATGCGCCAGCGGTTGATGTGATGGGAGCCCTTCTTCTTCTGCTCA

AACTGAGGCCGTTGCTCCTCCAGCTTCTGCCGTTTGTACTTTGTCCTCCG

GTTCTGGAACCACACCTTCACCTGGGCCAGGGAGGGAGGGGCACAGATGA

HEK293 site 3 sense (SEQ ID NO: 582)

CATGCAATTAGTCTATTTCTGCTGCAAGTAAGCATGCATTTGTAGGCTT

GATGCTTTTTTTCTGCTTCTCCAGCCCTGGCCTGGGTCAATCCTTGGGG

-continued

CTTAGACTGAGCACGTGATGGCAGAGGAAAGGAAGCCCTGCTTCCTCCA
GAGGGCGTCGCAGGACAGCTTTTCCTAGACAGGGGCTAGTATGTGCAGC
TCCT

HEK293 site 3 antisense (SEQ ID NO: 583)

AGGAGCTGCACATACTAGCCCCTGTCTAGGAAAAGCTGTCCTGCGACGC
CCTGTGGAGGAAGCAGGGCTTCCTTTCCTCTGCCATCACGTGCTCAGTC
TAAGCCCCAAGGATTGACCCAGGCCAGGGCTGGAGAAGCAGAAAAAAAG
CATCAAGCCTACAAATGCATGCTACTTGCAGCAGAAATAGACTAATTGC
ATG

HEK site 4 sense (SEQ ID NO: 584)

GGCTGACAAAGGCCGGGCTGGGTGGAAGGAAGGGAGGAAGGGCGAGGCA
GAGGGTCCAAAGCAGGATGACAGGCAGGGGCACCGCGGCGCCCCGGTGG
CATTGCGGCTGGAGGTGGGGGTTAAAGCGGAGACTCTGGTGCTGTGTGA
CTACAGTGGGGGCCCTGCCCTCTCTGAGCCCCGCCTCCAGGCCTGTGT
GTGT

HEK site 4 antisense (SEQ ID NO: 585)

ACACACACAGGCCTGGAGGCGGGGGCTCAGAGAGGGCAGGGCCCCCACT
GTAGTCACACAGCACCAGAGTCTCCGCTTTAACCCCCACCTCCAGCCGC
AATGCCACCGGGGCGCCGCGGTGCCCCTGCCTGTCATCCTGCTTTGGAC
CCTCTGCCTCGCCCTTCCTCCCTTCCTTCCACCCAGCCCGGCCTTTGTC
AGCC

APOE4 sense (SEQ ID NO: 743)

AGCACCGAGGAGCTGCGGGTGCGCCTCGCCTCCCACCTGCGCAAGCTGCG
TAAGCGGCTCCTCCGCGATGCCGATGACCTGCAGAAGTGCCTGGCAGTGT
ACCAGGCCGGGGCCCGCGAGGGCGCCGAGCGCGGCCTCAGCGCCATCCGC
GAGCGCCTGGGGCCCCTGGTGGAACAGGGCCGCGTGCGGGCCGCCACTGT

APOE4 antisense (SEQ ID NO: 744)

ACAGTGGCGGCCCGCACGCGGCCCTGTTCCACCAGGGGCCCCAGGCGCTC
GCGGATGGCGCTGAGGCCGCGCTCGGCGCCCTCGCGGGCCCCGGCCTGGT
ACACTGCCAGGCACTTCTGCAGGTCATCGGCATCGCGGAGGAGCCGCTTA
CGCAGCTTGCGCAGGTGGGAGGCGAGGCGCACCCGCAGCTCCTCGGTGCT p53 Y163C sense (SEQ ID NO: 745)

ACTCCCTGCCCTCAACAAGATGTTTTGCCAACTGGCCAAGACCTGCCCT
GTGCAGCTGTGGGTTGATTCCACACCCCCGCCCGGCACCCGCGTCCGCGC
CATGGCCATCTACAAGCAGTCACAGCACATGACGGAGGTTGTGAGGCGCT
GCCCCCACCATGAGCGCTGCTCAGATAGCGATGGTGAGCAGCTGGGGCTG p53 Y163C antisense (SEQ ID NO: 746)

CAGCCCCAGCTGCTCACCATCGCTATCTGAGCAGCGCTCATGGTGGGGC
AGCGCCTCACAACCTCCGTCATGTGCTGTGACTGCTTGTAGATGGCCATG
GCGCGGACGCGGGTGCCGGGCGGGGTGTGGAATCAACCCACAGCTGCAC
AGGGCAGGTCTTGGCCAGTTGGCAAAACATCTTGTTGAGGGCAGGGGAGT

Deaminase gene gBlocks Gene Fragments
hAID (SEQ ID NO: 586)

CATCCTTGGTACCGAGCTCGGATCCAGCCACCATGGATAGCCTCTTGAT
GAATAGACGCAAGTTCCTGTATCAGTTTAAAAACGTGAGATGGGCAAAA
GGCCGACGAGAGACATATCTGTGCTATGTCGTTAAGCGCAGAGATTCAG
CCACCAGTTTCTCTCTCGACTTCGGCTACCTGCGGAACAAGAATGGTTG
CCATGTTGAGCTCCTGTTCCTGAGGTATATCAGCGACTGGGATTTGGAC
CCAGGGCGGTGCTATAGGGTGACATGGTTTACCTCCTGGTCACCTTGTT
ATGACTGCGCGCGGCATGTTGCCGATTTTCTGAGAGGGAACCCTAACCT
GTCTCTGAGGATCTTCACCGCGCGACTGTACTTCTGTGAGGACCGGAAA
GCCGAACCCGAGGGACTGAGACGCCTCCACAGAGCGGGTGTGCAGATTG
CCATAATGACCTTTAAGGACTACTTCTACTGCTGGAACACCTTCGTCGA
AAATCACGAGCGGACTTTCATGGCTTGGGAAGGATTGCATGAAAACAGC
GTCAGGCTCCAGGCAGCTTCGCCGCATTCTTCTCCCGTTGTACGAGGTT
GATGACCTCAGAGATGCCTTTAGAACACTGGGACTGTAGGCGGCCGCTC
GATTGGTTTGGTGTGGCTCTAA rAPOBEC1 (mammalian) (SEQ ID NO: 587)

CATCCTTGGTACCGAGCTCGGATCCAGCCACCATGAGCTCAGAGACTGGC
CCAGTGGCTGTGGACCCCACATTGAGACGGCGGATCGAGCCCCATGAGTT
TGAGGTATTCTTCGATCCGAGAGAGCTCCGCAAGGAGACCTGCCTGCTTT
ACGAAATTAATTGGGGGGGCCGGCACTCCATTTGGCGACATACATCACAG
AACACTAACAAGCACGTCGAAGTCAACTTCATCGAGAAGTTCACGACAGA
AAGATATTTCTGTCCGAACACAAGGTGCAGCATTACCTGGTTTCTCAGCT
GGAGCCCATGCGGCGAATGTAGTAGGGCCATCACTGAATTCCTGTCAAGG
TATCCCCACGTCACTCTGTTTATTTACATCGCAAGGCTGTACCACCACGC
TGACCCCCGCAATCGACAAGGCCTGCGGGATTTGATCTCTTCAGGTGTGA
CTATCCAAATTATGACTGAGCAGGAGTCAGGATACTGCTGGAGAAACTTG
TGAATTATAGCCCGAGTAATGAAGCCCACTGGCCTAGGTATCCCCATCTG
TGGGTACGACTGTACGTTCTTGAACTGTACTGCATCATACTGGGCCTGCC
TCCTTGTCTCAACATTCTGAGAAGGAAGCAGCCACAGCTGACATTCTTTA
CCATCGCTCTTCAGTCTTGTCATTACCAGCGACTGCCCCCACACATTCTC
TGGGCCACCGGGTTGAAATGAGCGGCCGCTCGATTGGTTTGGTGTGGCTC
TAA pmCDA1 (SEQ ID NO: 588)

```
CATCCTTGGTACCGAGCTCGGATCCAGCCACCATGACAGACGCTGAAT
ATGTTAGGATCCATGAAAAACTGGATATCTATACATTTAAGAAGCAGT
TCTTCAATAACAAAAAGTCAGTATCTCACAGATGCTATGTCCTGTTCG
AACTCAAGAGAAGAGGAGAAAGGCGGGCCTGTTTCTGGGGGTACGCGG
TTAATAAACCCCAGTCCGGGACCGAGAGGGGGATTCACGCCGAGATCT
TTTCAATTAGGAAGGTTGAAGAGTATCTTCGCGACAATCCCGGTCAGT
TCACAATTAACTGGTACAGCTCCTGGAGCCCTTGCGCTGATTGCGCCG
AGAAAATACTCGAATGGTACAACCAGGAGTTGAGAGGCAATGGCCACA
CTCTCAAGATTTGGGCTTGCAAGCTTTACTACGAGAAGAACGCGAGAA
ATCAGATTGGCTTGTGGAACCTCAGGGACAACGGGTCGGGTTGAATG
TTATGGTGTCCGAACATTACCAGTGCTGTAGAAAGATCTTCATTCAGT
CCAGTCACAATCAGCTGAACGAGAACAGATGGCTGGAGAAAACACTGA
AACGGGCAGAGAAAGGCGCTCAGAGCTGAGTATCATGATCCAGGTCA
AAATCCTGCATACAACCAAAAGCCCGGCTGTATAAGCGGCCGCTCGAT
TGGTTTGGTGTGGCTCTAA
``` haPOBEC3G (SEQ ID NO: 589)

```
CATCCTTGGTACCGAGCTCGGATCCAGCCACCATGGAGCTGAAGTATCAC
CCTGAGATGCGGTTCCACTGGTTTAGTAAGTGGCGCAAACTTCATCGGGA
TCAGGAGTATGAAGTGACCTGGTATATCTCTTGGTCTCCCTGCACAAAAT
GTACACGCGACATGGCCACATTTCTGGCCGAGGATCCAAAGGTGACGCTC
ACAATCTTTGTGGCCCGCCTGTATTATTTCTGGGACCCGGATTATCAGGA
GGCACTTAGGTCATTGTGCCAAAAGCGCGACGGACCACGGGCGACTATGA
AAATCATGAATTATGACGAATTCCAGCATGCTGGAGTAAGTTGTGTACAG
CCAGCGGGAGCTGTTCGAGCCCTGGAACAATCTTCCCAAGTACTACATAC
TGCTTCACATTATGTTGGGGGAGATCCTTCGGCACTCTATGGATCCTCCT
ACCTACGTTAACTTTAATAATGAGCCTTGGGTTCGCGGGCGCCATGAAAC
CTATTTGTGCTACGAGGTCGAGCGGATGCATAATGATACGTGGGTCCTGC
TGAATCAGAGGAGGGGTTTCTGTGTAACCAGGCTCCACATAAACATGGA
TTTCTCGAGGGGCGGCACGCCGAACTGTGTTTCCTTGATGTGATACCTTC
TGGAAGCTCGACCTTGATCAAGATTACAGGGTGACGTGTTTCACCTCCTG
GTCACCCTGCTTCAGTTGCGCCCAAGAGATGGCTAAATTTATCAGTAAGA
ACAAGCATGTGTCCCTCTGTATTTTTACAGCCAGAATTTATGATGACCAG
GGCCGGTGCCAGGAGGGCTGCGGACACTCGCTGAGGCGGGCGCGAAGAT
CAGCATAATGACATACTCCGAATTCAAACACTGTTGGGACACTTTTGTGG
ACCACCAGGGCTGCCCATTTCAGCCGTGGGATGGGCTCGACGAACATAGT
CAGGATCTCTCAGGCCGGCTGCGAGCCATATTGCAGAACCAGGAGAATTA
GGCGGCCGCTCGATTGGTTTGGTGTGGCTCTAA
``` rAPOBEC1(E. Coli) (SEQ ID NO: 590)

```
GGCCGGGGATTCTAGAAATAATTTTGTTTAACTTTAAGAAGGAGATATAC
CATGGATGTCTTCTGAAACCGGTCCGGTTGCGGTTGACCCGACCCTGCGT
CGTCGTATCGAACCGCACGAATTCGAAGTTTTCTTCGACCCGCGTGAAC|
TGCGTAAAGAAACCTGCCTGCTGTACGAAATCAACTGGGGTGGTCGTCAC
TCTATCTGGCGTCACACCTCTCAGAACACCAACAAACACGTTGAAGTTAA
CTTCATCGAAAAATTCACCACCGAACGTTACTTCTGCCCGAACACCCGTT
GCTCTATCACCTGGTTCCTGTCTTGGTCTCCGTGCGGTGAATGCTCTCGT
GCGATCACCGAATTCCTGTCTCGTTACCCGCACGTTACCCTGTTCATCTA
CATCGCGCGTCTGTACCACCACGCGGACCCGCGTAACCGTCAGGGTCTGC
GTGACCTGATCTCTTCTGGTGTTACCATCCAGATCATGACCGAACAGGAA
TCTGGTTACTGCTGGCGTAACTTCGTTAACTACTCTCCGTCTAACGAAGC
GCACTGGCCGCGTTACCCGCACCTGTGGGTTCGTCTGTACGTTCTGGAAC
TGTACTGCATCATCCTGGGTCTGCCGCCGTGCCTGAACATCCTGCGTCGT
AAACAGCCGCAGCTGACCTTCTTCACCATCGCGCTGCAGTCTTGCCACTA
CCAGCGTCTGCCGCCGCACATCCTGTGGGCGACCGGTCTGAAAGGTGGTA
GTGGAGGGAGCGGCGGTTCAATGGATAAGAAATAC
```

Amino Acid Sequences of NBE1, NBE2, and NBE3.
NBE1 for *E. Coli* expression (His$_6$-rAPOBEC1-XTEN-dCas9) (SEQ ID NO: 591)

```
MGSSHHHHHHMSSETGPVAVDPTLRRRIEPHEFEVFFDPRELRKETCLL
YEINWGGRHSIWRHTSQNTNKHVEVNFIEKFTTERYFCPNTRCSITWFL
SWSPCGECSRAITEFLSRYPHVTLFIYARLYHHADPRNRQGLRDLISSG
VTIQIMTEQESGYCWRNFVNYSPSNEAHWPRYPHLWVRLYVLELYCIIL
GLPPCLNILRRKQPQLIFFTIALQSCHYQRLPPHILWATGLKSGSETPG
TSESATPESDKKYSIGLAIGTNSVGWAVITDEYKVPSKKFKVLGNTDRH
SIKKNLIGALLFDSGETAEATRLKRTARRRYTRRKNRICYLQEIFSNEM
AKVDDSFFHRLEESFLVEEDK|KHERHPIFGNIVDEVAYHEKYPTIYHL
RKKLVDSTDKADLRLIYLALAHMIKFRGHFLIEGDLNPDNSDVDKLFIQ
LVQTYNQLFEENPINASGVDAKAILSARLSKSRRLENLIAQLPGEKKNG
LFGNLIALSLGLTPNFKSNFDLAEDAKLQLSKDTYDDDLDNLLAQIGDQ
YADLFLAAKNLSDAILLSDILRVNTEITKAPLSASMIKRYDEHHQDLTL
LKALVRQQLPEKYKEIFFDQSKNGYAGYIDGGASQEEFYKFIKPILEKM
DGTEELLVKLNREDLLRKQRTFDNGSIPHQIHLGELHAILRRQEDFYPF
LKDNREKIEKILTFRIPYYVGPLARGNSRFAWMTRKSEETITPWNFEEV
VDKGASAQSFIERMTNFDKNLPNEKVLPKHSLLYEYFTVYNELTKVKYV
TEGMRKPAFLSGEQKKAIVDLLFKTNRKVTVKQLKEDYFKKIECFDSVE
ISGVEDRFNASLGTYHDLLKIIKDKDFLDNEENEDILEDIVLTLTLFED
REMIEERLKTYAHLFDDKVMKQLKRRRYTGWGRLSRKLINGIRDKQS
GKTILDFLKSDGFANRNFMQLIHDDSLTFKEDIQKAQVSGQGDSLHEHI
```

ANLAGSPAIKKGILQTVKVVDELVKVMGRHKPENIVIEMARENQTTQKG

QKNSRERMKRIEEGIKELGSQILKEHPVENTQLQNEKLYLYYLQNGRDM

YVDQELDINRLSDYDVDAIVPQSFLKDDSIDNKVLTRSDKNRGKSDNVP

SEEVVKKMKNYWRQLLNAKLITQRKFDNLTKAERGGLSELDKAGFIKRQ

LVETRQITKHVAQILDSRMNTKYDENDKLIREVKVITLKSKLVSDFRKD

FQFYKVREINNYHHAHDAYLNAVVGTALIKKYPKLESEFVYGDYKVYDV

RKMIAKSEQEIGKATAKYFFYSNIMNFFKTEITLANGEIRKRPLIETNG

ETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLG

ITIMERSSFEKNPIDFLEAKGYKEVKKDLIIKLPKYSLFELENGRKRML

ASAGELQKGNELALPSKYVNFLYLASHYEKLKGSPEDNEQKQLFVEQHK

HYLDEIIEQISEFSKRVILADANLDKVLSAYNKHRDKPIREQAENIIHL

FTLTNLGAPAAFKYFDTTIDRKRYTSTKEVLDATLIHQSITGLYETRID

LSQLGGDSGGSPKKKRKV

NBE1 for Mammalian expression (rAPOBEC1-XTEN-dCas9-NLS) (SEQ ID NO: 592)

MSSETGPVAVDPTLRRRIEPHEFEVFFDPRELRKETCLLYEINWGGRHS

IWRHTSQNTNKHVEVNFIEKFTTERYFCPNTRCSITWFLSWSPCGECSR

AITEFLSRYPHVTLFIYIARLYHHADPRNRQGLRDLISSGVTIQIMTEQ

ESGYCWRNFVNYSPSNEAHWPRYPHLWVRLYVLELYCIILGLPPCLNIL

RRKQPQLTFFTIALQSCHYQRLPPHILWATGLKSGSETPGTSESATPES

DKKYSIGLAIGTNSVGWAVITDEYKVPSKKFKVLGNTDRHSIKKNLIGA

LLFDSGETAEAT|RLKRTARRRYTRRKNRICYLQEIFSNEMAKVDDSFF

HRLEESFLVEEDKKHERHPIFGNIVDEVAYHEKYPTIYHLRKKLVSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDDIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGDSGGS

PKKKRKV

Alternative NBE1 for Mammalian expression with human APOBEC1 (hAPOBEC1-XTEN-dCas9-NLS) (SEQ ID NO: 5737)

MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQ

NHLTFFRLHLQNCHYQTIPPHILLATGLIHPSVAWRGSETPGTSESATPE

SDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

-continued

GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGDSGGSPKKKRKV

NBE2 (rAPOBEC1-XTEN-dCas9-UGI-NLS) (SEQ ID NO: 593)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANG
EIRKRPLIETNGETGEIVWDKGRDFATVRKVLSMPQVNIVKKTEVQTGGF
SKESILPKRNSDKUARKKDWDPKKYGGFDSPTVAYSVLVVAKVEKGKSKK
LKSVKELLGMMERSSFEKNPIDFLEAKGYKEVKKDLIIKLPKYSLFELEN
GRKRMLASAGELQKGNELALPSKYVNFLYLASHYEKLKGSPEDNEQKQLF
VEQHKHYLDEIIEQISEFSKRVILADANLDKVLSAYNKHRDKPIREQAEN
IIHLFTLTNLGAPAAFKYFDTTIDRKRYTSTKEVLDATLIHQSITGLYET
RIDLSQLGGDSGGSTNLSDIIEKETGKQLVIQESILMLPEEVEEVIGNKP
ESDILVHTAYDESTDENVMLLTSDAPEYKPWALVIQDSNGENKIKMLSGG
SPKKKRKV

NBE3 (rAPOBEC1-XTEN-Cas9n-UGI-NLS) (SEQ ID NO: 594)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANG
EIRKRPLIETNGETGEIVWDKGRDFATVRKVLSMPQVNIVKKTEVQTGGF
SKESILPKRNSDKUARKKDWDPKKYGGFDSPTVAYSVLVVAKVEKGKSKK
LKSVKELLGMMERSSFEKNPIDFLEAKGYKEVKKDLIIKLPKYSLFELEN
GRKRMLASAGELQKGNELALPSKYVNFLYLASHYEKLKGSPEDNEQKQLF
VEQHKHYLDEIIEQISEFSKRVILADANLDKVLSAYNKHRDKPIREQAEN
IIHLFTLTNLGAPAAFKYFDTTIDRKRYTSTKEVLDATLIHQSITGLYET
RIDLSQLGGDSGGSTNLSDIIEKETGKQLVIQESILMLPEEVEEVIGNKP
ESDILVHTAYDESTDENVMLLTSDAPEYKPWALVIQDSNGENKIKMLSGG
SPKKKRKV pmCDA1-XTEN-dCas9-UGI (bacteria) (SEQ ID NO: 5742)

MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAVSGSETPGTSESATPESDKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN
FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VEISGVEDRFNASLGTYHDLLKIIKDKDFLDNEENEDILEDIVLTLTLFE
DREMIEERLKTYAHLFDDKVMKQLRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDAIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGDSGGSMTNLS
DIIEKETGKQLVIQESILMLPEEVEEVIGNKPESDILVHTAYDESTDENV
MLLTSDAPEYKPWALVIQDSNGENKIKML pmCDA1-XTEN-nCas9-UGI-NLS (mammalian construct) (SEQ ID NO: 5743)

MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAVSGSETPGTSESATPESDKKYSIGLAIGTNSVGWAVITDEYKV
PSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVA
YHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIK
PILEKMDGTEELLVKLNREDLLRKQRTFDNGSIPHQIHLGELHAILRRQE
DFYPFLKDNREKIEKILTFRIPYYVGPLARGNSRFAWMTRKSEETITPWN
FEEVVDKGASAQSFIERMTNFDKNLPNEKVLPKHSLLYEYFTVYNELTKV
KYVTEGMRKPAFLSGEQKKAIVDLLFKTNRKVTVKQLKEDYFKKIECFDS
VEISGVEDRFNASLGTYHDLLKIIKDKDFLDNEENEDILEDIVLTLTLFE
DREMIEERLKTYAHLFDDKVMKQLRRRYTGWGRLSRKLINGIRDKQSGK
TILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNS
RERMKRIEEGIKELGSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGDSGGSTNLSD
IIEKETGKQLVIQESILMLPEEVEEVIGNKPESDILVHTAYDESTDENVM
LLTSDAPEYKPWALVIQDSNGENKIKMLSGGSPKKKRKV huAPOBEC3G-XTEN-dCas9-UGI (bacteria) (SEQ ID NO: 5744)

MDPPTFTFNFNNEPWVRGRHETYLCYEVERMHNDTWVLLNQRRGFLCNQAP
HKHGFLEGRHAELCFLDVIPFWKLDLDQDYRVTCFTSWSPCFSCAQEMAKF
ISKNKHVSLCIFTARIYDDQGRCQEGLRTLAEAGAKISIMTYSEFKHCWDT
FVDHQGCPFQPWDGLDEHSQDLSGRLRAILQSGSETPGTSESATPESDKKY
SIGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAK
AILSARLSKSRRLENLIAQLPGEKKNGLFGNLIALSLGLTPNFKSNFDLAE
DAKLQLSKDTYDDDLDNLLAQIGDQYADLFLAAKNLSDAILLSDILRVNTE
ITKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPHQ
IHLGELHAILRRQEDFYPFLKDNREKIEKILTFRIPYYVGPLARGNSRFAW
MTRKSEETITPWNFEEVVDKGASAQSFIERMTNFDKNLPNEKVLPKHSLLY
EYFTVYNELTKVKYVTEGMRKPAFLSGEQKKAIVDLLFKTNRKVTVKQLKE
DYFKKIECFDSVETSGVEDRFNASLGTYHDLLKIIKDKDFLDNEENEDILE
DIVLTLTLFEDREMIEERLKTYAHLFDDKVMKQLKRRYTGWGRLSRKLIN
GIRDKQSGKTILDFLKSDGFANRNFMQLIHDDSLTFKEDIQKAQVSGQGDS
LHEHIANLAGSPAIKKGILQTVKVVDELVKVMGRHKPENIVIEMARENQTT
QKGQKNSRERMKRIEEGIKELGSQILKEHPVENTQLQNEKLYLYYLQNGRD
MYVDQELDINRLSDYDVDAIVPQSFLKDDSIDNKVLTRSDKNRGKSDNVPS
EEVVKKMKNYWRQLLNAKLITQRKFDNLTKAERGGLSELDKAGFIKRQLVE
TRQITKHVAQILDSRMNTKYDENDKLIREVKVITLKSKLVSDFRKDFQFYK
VREINNYHHAHDAYLNAVVGTALIKKYPKLESEFVYGDYKVYDVRKMIAKS
EQEIGKATAKYFFYSNIMNFFKTEITLANGEIRKRPLIETNGETGEIVWDK
GRDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALP
SKYVNFLYLASHYEKLKGSPEDNEQKQLFVEQHKHYLDEIIEQISEFSKRV
ILADANLDKVLSAYNKHRDKPIREQAENIIHLFTLTNLGAPAAFKYFDTTI
DRKRYTSTKEVLDATLIHQSITGLYETRIDLSQLGGDSGGSMTNLSDIIEK
ETGKQLVIQESILMLPEEVEEVIGNKPESDILVHTAYDESTDENVMLLTSD
APEYKPWALVIQDSNGENKIKML huAPOBEC3G-XTEN-nCas9-UGI-NLS (mammalian construct) (SEQ ID NO: 5745)

MDPPTFTFNFNNEPWVRGRHETYLCYEVERMHNDTWVLLNQRRGFLCNQA
PHKHGFLEGRHAELCFLDVIPFWKLDLDQDYRVTCFTSWSPCFSCAQEMA
KFISKNKHVSLCIFTARIYDDQGRCQEGLRTLAEAGAKISIMTYSEFKHC
WDTFVDHQGCPFQPWDGLDEHSQDLSGRLRAILQSGSETPGTSESATPES
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGDSGGSTNLSDIIEKETGKQLVIQESILMLPEEVE
EVIGNKPESDILVHTAYDESTDENVMLLTSDAPEYKPWALVIQDSNGENK
IKMLSGGSPKKKRKV huAPOBEC3G (D316R_D317R)-XTEN-nCas9-UGI-NLS (mammalian construct) (SEQ ID NO: 5746)

MDPPTFTFNFNNEPWVRGRHETYLCYEVERMHNDTWVLLNQRRGFLCNQA
PHKHGFLEGRHAELCFLDVIPFWKLDLDQDYRVTCFTSWSPCFSCAQEMA
KFISKNKHVSLCIFTARIYRRQGRCQEGLRTLAEAGAKISIMTYSEFKHC
WDTFVDHQGCPFQPWDGLDEHSQDLSGRLRAILQSGSETPGTSESATPES
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII

-continued

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

-continued

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGDSGGSTNLSDIIEKETGKQLVIQESILMLPEEVE

EVIGNKPESDILVHTAYDESTDENVMLLTSDAPEYKPWALVIQDSNGENK

IKMLSGGSPKKKRKV

Base Calling Matlab Script (SEQ ID NO: 595)

```
WTnuc='GCGGACATGGAGGACGTGCGCGGCCGCCTGGTGCAGTACCGCGGCGAGGTGCAGGCCATGCTCGGC
CAGA
GCACCGAGGAGCTGCGGGTGCGCCTCGCCTCCCACCTGCGCAAGCTGCGTAAGCGGCTCCTCCGCGATGCCG
ATGAC
CTGCAGAAGCGCCTGGCAGTGTACCAGGCCGGGGCCCGCGAGGGCGCCGAGCGCGGCCTCAGCGCCATCCGC
GAGCG CCTGGGGCCCCTGGTGGAACAG';

%cycle through fastq files for different samples files=dir('*.fastq');
ford=1:20
filename=files(d).name;
%read fastq file
[header,seqs,qscore]=fastqread(filename);
seqsLength=length(seqs); % number of sequences seqsFile=
strrep(filename,'.fastq',''); % trims off .fastq
%create a directory with the same name as fastq file ifexist(seqsFile,'dir');
error(Directory already exists. Please rename or move it before moving on.');
end
mkdir(seqsFile); % make directory
wtLength = length(WTnuc); % length of wildtype sequence
%% aligning back to the wildtype nucleotide sequence
%
% A1N is a matrix of the nucleotide alignment window=1:wtLength;
sBLength =length(seqs); % number of sequences
% counts number of skips nSkips = 0;
ALN=repmat('',[sBLengthwtLength]);
% iterate through each sequencing read for i = 1:sBLength
%If you only have forward read fastq files leave as is
%If you have R1 foward and R2 is reverse fastq files uncomment the
%next four lines of code and the subsequent end statement
% ifmod(d,2)==0;
% reverse = seqrcomplement(seqs{i});
% [score,alignment,start]=
swalign(reverse,WTnuc,'Alphabet','NT');
% else
[score,alignment,start]=swalign(seqs{i},WTnuc,'Alphabet','NT');
% end
% length of the sequencing read len=
length(alignment(3,:));
% if there is a gap in the alignment, skip = 1 and we will
% throwaway the entire read skip = 0;
for j = 1:len
if (alignment(3,j) == '-' || alignment(1,j) == '-') skip = 1;
break;
end
%in addition if the qscore for any given base in the read is
%below 31 the nucleotide is turned into an N (fastq qscores that are not letters)
ifisletter(qscore {i}(start(1)+j-1)) else
alignment(1,j) ='N';
end
end
if skip == 0 && len>10
ALN(i, start(2):(start(2)+Length(alignment)-1))=alignment(1,:);
end
end
% with the alignment matrices we can simply tally up the occurrences of
% each nucleotide at each column in the alignment these
%tallies ignore bases annotated as N
% due to low qscores
```

-continued

```
TallyNTD=zeros(5,wtLength); fori=1:wtLength
TallyNTD(:,i)=1sum(ALN(:,i)=='A'),sum(ALN(:,i)=='C'),sum(ALN(:,i)=='G'),sum(A
LN(:,i)=='T'),sum(ALN(:,i)=='N')+ ;
end
% we then save these tally matrices in the respective folder for
% further processing
save(strcat(seqsFile,'/TallyNTD'),'TallyNTD'); dlmwrite(strcat(seqsFile,'/TallyNTD.txt'),TallyNTD,
'precision',
'%.3f','newline','pc'); end
```

INDEL Detection Matlab Script (SEQ ID NO: 595)
```
WTnuc='GCGGACATGGAGGACGTGCGCGGCCGCCTGGTGCAGTACCGCGGCGAGGTGCAGGCCATGCTCGGC
CAGA
GCACCGAGGAGCTGCGGGTGCGCCTCGCCTCCCACCTGCGCAAGCTGCGTAAGCGGCTCCTCCGCGATGCCG
ATGAC
CTGCAGAAGCGCCTGGCAGTGTACCAGGCCGGGGCCCGCGAGGGCGCCGAGCGCGGCCTCAGCGCCATCCGC
GAGCG CCTGGGGCCCCTGGTGGAACAG';
%cycle through fastq files for different samples files=dir('*.fastq');
%specify start and width of indel window as well as length of each flank indelstart+32154;
width=30; flank=10;
ford=1:3
filename=files(d).name;
%read fastq file
[header,seqs,qscore]=fastqread(filename);
seqsLength=length(seqs); % number of sequences seqsFile
=strcat(strrep(filename,'.fastq',''),'_INDELS');
%create a directory with the same name as fastq file+_INDELS ifexist(seqsFile,'dir');
error('Directory already exists. Please rename or move it before moving on.');
end
mkdir(seqsFile); % make directory
wtLength= length(WTnuc); % length of wildtype sequence sBLength =
length(seqs); % number of sequences
% initialize counters and cell arrays
nSkips =0; notliNDEL=;
ins={ };
dels={ }; NumIns=0;
NumDels=0;
% iterate through each sequencing read for i = 1:sBLength
%search for 10BP sequences that should flank both sides of the "INDEL WINDOW"
windowstart=strfind(seqs {i},WTnuc(indelstart-flank:indelstart));
windowend=strfind(seqs{i},WTnuc(indelstart+width:indelstart+width+flank
));
%if the flanks are found proceed
iflength(windowstart)==1 &&length(windowend)==1
%if the sequence length matches the INDEL window length save as
%not INDEL
if windowend-windowstart==width+flank notINDEL=notINDEL+1;
%if the sequence is two or more bases longer than the INDEL
%window length save as an Insertion
elseif windowend-windowstart>=width+flank'NumIns=NumIns+1;
ins {NumIns}=seqs{i};
%if the sequence is two or more bases shorter than the INDEL
%window length save as a Deletion
elseif
windowend-windowstart>=width+flank-2 NumDels=NumDels+1;
dels 1 NumDels 1 =seqs{i};
%keep track of skipped sequences that are either one base
%shorter or longer than the INDEL window width else
nSkips=nSkips+1;
end
%keep track of skipped sequences that do not possess matching flank
%sequences else
nSkips=nSkips+1;
end
end
fid=fopen(strcadseqsFile,7summary.txtXwt);
fprintf(fid, 'Skipped reads %An not INDEL %An Insertions %An Deletions
%An', +nSkips, notINDEL, NumIns, NumDels+); fclose(fid);
save(strcadseqsFile,7nSkips'VnSkips'); save(strcat(seqsFile,'/notINDEL'),'notINDEL');
save(strcat(seqsFile,'/NumIns'),'NumIns'); save(strcat(seqsFile,'/NumDels'),'NumDels');
save(strcat(seqsFile,'/dels'),'dels');
C = dels;
fid = fopen(strcat(seqsFile, '/dels.txt'), 'wt');
fprintf(fid, '"%s" \n', C{:1);
fclose(fid);
save(strcat(seqsFile,'/ins'),'ins'); C =ins;
fid = fopen(strcat(seqsFile, '/ins.txt'), 'wt');
```

```
fprintf(fid, '"%s" \n', C {:1});
fclose(fid);
end
```

Example 5

Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterek, of a Cas9 protein may be mutated. In some embodiments, the D10 and/or H840 residues of the amino acid sequence provided in SEQ ID NO: 10, or a corresponding mutation in any of the amino acid sequences provided in SEQ ID NOs: 11-260, are mutated. In some embodiments, the D10 residue of the amino acid sequence provided in SEQ ID NO: 10, or a corresponding mutation in any of the amino acid sequences provided in SEQ ID NOs: 11-260, is mutated to any amino acid residue, except for D. In some embodiments, the D10 residue of the amino acid sequence provided in SEQ ID NO: 10, or a corresponding mutation in any of the amino acid sequences provided in SEQ ID NOs: 11-260, is mutated to an A. In some embodiments, the H840 residue of the amino acid sequence provided in SEQ ID NO: 10, or a corresponding residue in any of the amino acid sequences provided in SEQ ID NOs: 11-260, is an H. In some embodiments, the H840 residue of the amino acid sequence provided in SEQ ID NO: 10, or a corresponding mutation in any of the amino acid sequences provided in SEQ ID NOs: 11-260, is mutated to any amino acid residue, except for H. In some embodiments, the H840 residue of the amino acid sequence provided in SEQ ID NO: 10, or a corresponding mutation in any of the amino acid sequences provided in SEQ ID NOs: 11-260, is mutated to an A. In some embodiments, the D10 residue of the amino acid sequence provided in SEQ ID NO: 10, or a corresponding residue in any of the amino acid sequences provided in SEQ ID NOs: 11-260, is a D.

A number of Cas9 sequences from various species were aligned to determine whether corresponding homologous amino acid residues of D10 and H840 of SEQ ID NO: 10 or SEQ ID NO: 11 can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties −11, −1; End-Gap penalties −5, −1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 11|WP_010922251|gi 499224711|type II CRISPR RNA-guided endonuclease Cas9 [*Streptococcus pyogenes*]; Sequence 2 (S2): SEQ ID NO: 12|WP_039695303|gi 746743737|type II CRISPR RNA-guided endonuclease Cas9 [*Streptococcus gallolyticus*]; Sequence 3 (S3): SEQ ID NO: 13|WP_045635197|gi 782887988|type II CRISPR RNA-guided endonuclease Cas9 [*Streptococcus mitis*]; Sequence 4 (S4): SEQ ID NO: 14|AXW_A|gi 924443546|*Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1    1   --MDKK-                                                                          73
          YSIGLD*IGTNSVGNAVITDEYKVPSKKFKVLGNTDRHSIKKNLI--GALLFDSG--ETAEATRLKRTARRRYT
S2    1   --MTKKN                                                                          74
          YSIGLD*IGTNSVGNAVITDDYKVPAKKMKVLGNTDKKYIKKNLL--GALLFDSG--ETAEATRLKRTARRRYT
S3    1   --M-KKG                                                                          73
          YSIGLD*IGTNSVGFAVITDDYKVPSKKMKVLGNTDKRFIKKNLI--GALLFDEG--TTAEARRLKRTARRRYT
S4    1   GSHMKRN                                                                          61
          YILGLD*IGITSVGYGII--DYET----------------RDVIDAGVRLFKEANVENNEGRRSKRGARRLKR

S1   74   RRKNRICYLQEIFSNEMAKVDDSFFHRLEESFLVEEDKKHERHPIFGNIVDEVAYHEKYPTIYHLRKKLVDSDKADLRL  153
S2   75   RRKNRLRYLQEIFANEIAKVDESFFQRLDESFLTDDDKTFDSHPIFGNKAEEDAYHQKPTIYHLRHLADSSEKADLRL  154
S3   74   RRKNRLRYLQEIFSEEMSKVDSSFFWRLDDSFLIPEDKRESKYPIFATLTEEKEYHKQFPTIYHLRKQLADSKEKTDLRL 153
S4   62   RRRHRIQRVKKLI-------------FDYNLLTD-------------------HSELSGINPYEARVKGLSQKLSEE  107

S1  154   IYLALAHMIKFRGHFLIEGDLNPDNSDVDKLFIQLVQTYNQLFEENPINASGVDAKAILSARLSKSRRLENLIAQLPGEK 233
S2  155   VYLALAHMIKFRGHFLIEGELNAENTDVQKIFADFVGVYNRTFDDSHLSEITVDVASILTEKISKSRRLENLIKYYPTEK 234
S3  154   IYLALAHMIKYRGHFLYEEAFDIKNNDIQKIFNEFISIYDNTFEGSSLSGQNAQVEAIFTDKISKSAKRERVLKLFPDEK 233
S4  108   FSALLHLAKRRG-------------------VHNVNEVEEDT-----------------------------         131

S1  234   KNGLFGNLIALSLGLTPNFKSNFDLAEDAKLQLSKDTYDDDLDNLLAQIGDQYADLFLAAKNLSDAILLSDILRVNTEIT 313
S2  235   KNTLFGNLIALALGLQPNFKTNFKLSEDAKLQFSKDTYEEDLEELLGKIGDDYADLFTSAKNLYDAILLSGILTVDDNST 314
S3  234   STGLFSEFLKLIVGNQADFKKHFDLEDKAPLQFSKDTYDEDLENLLGQIGDDFTDLFVSAKKLYDAILLSGILTVTDPST 313
S4  132   -----GNELS------------------TKEQISRN------------------------------              144

S1  314   KAPLSASMIKRYDEHHQDLTLLKALVRQQLPEKYKEIFFDQSKNGYAGYIDGGASQEEFYKFIKPILEEM--DGTEELLV 391
S2  315   KAPLSASMIKRYVEHHEDLEKLKEFIKANKSELYHDIFKDKNKNGYAGYIEGVKQDEFYKYLKNILSKIKIDGSDYFLD  394
S3  314   KAPLSASMIERYENHQNDLAALKQFIKNNLPEKYDEVFSDQSKDGYAGYIDGKTTQETFYKYIKNLLSKF--EGTDYFLD 391
S4  145   ----SKALEEKYVAELQ---------------------------------------LERLKKDG------          165

S1  392   KLNREDLLRKQRTFDNGSIPHQIHLGELHAILRRQEDFYPFLKDNREKIEKILTFRIPYYVGPLARGNSRFAWMTRKSEE 471
S2  395   KIEREDFLRKQRTFDNGSIPHQIHLQEMHAILRRQGDYYPFLKEKQDRIEKILTFRIPYYVGPLVRKDSRFAWAEYRSDE 474
S3  392   KIEREDFLRKQRTFDNGSIPHQIHLQEMNAILRRQGEYYPFLKDNKEKIEKILTFRIPYYVGPLARGNRDFAWLTRNSDE 471
S4  166   --EVRGSINRFKTSD--------YVKEAKQLLKVQKAYHQLDQSFIDTYIDLLETRRTYYEGP--GEGSPFGW------K 227
```

-continued

```
S1   472 TITPWNFEEVVDKGASAQSFIERMTNFDKNLPNEKVLPKHSLLYEYFTVYNELTKVKYVTEGRKPAFLSGEQKKAIVDL  551
S2   475 KITPWNFDKVIDKEKSAEKFITRMTLNDLYLPEEKVLPKHSVYETYAVYNELTKIKYVNEQGKE-SFFDSNMKQEIFDH  553
S3   472 AIRPWNFEEIVDKASSAEDFINKMTNYDLYLPEEKVLPKHSLLYETFAVYNELTKVKFIAEGLRDYQFLDSGQKKQIVNQ 551
S4   228 DIKEW---------------YEMLMGHCTYFPEELRSVKYAYNADLYNALNDLNNLVITRDENEK---LEYYEKFQIIEN  289

S1   552 LFKTNRKVTVKQLKEDYFKKIECFDSVEISGVEDR---FNASLGTYHDLLKIIKDKDFLDNEENEDILEDI-        628
             VILTLTLFED
S2   554 VFKENRKVTKELLNYLNKEFPEYRIKDLIGLDENKSFNASLGTYHDLKKIL-DKAFLDDKVNEEVIEDIIKTLTLFED  632
S3   552 LFKENRKVTEKDIIHYLHN-VDGYDGIELKGIEKQ---FNASLSTYHDLLKIIKDKEFMDDADNEAIIENIVHTLTIFED 627
S4   290 VFKQKKKPTLKQIAKEILVNEEDIKGYRVTSTGKPEF---TNLKVYHDIKDITARKEII---ENAELLDQIAKILTIYQS 363

S1   629 REMIEERLKTYAHLFDDKVMKQLKR-RRYTGWGRLSRKLINGIRDKQSGTILDFLKSDGFANRNFMQLIHDDSLTFKED  707
S2   633 KDMIHERLQKYSDIFTANQLKKLER-RHYTGWGRLSYKLINGIRNKENNKTILDYLIDDGSANRNFMQLINDDTLPFKQI 711
S3   628 REMIKQRLAQYDSLFDEKVIKALTR-RHYTTWTKLSAKLINGICDKQTGNTILDYLIDDGKINRNFMQLINDDGLSFKEI 706
S4   364 SEDIQEELTNLSELTQEEIEQISNLKGYGYHNLSLKAINLILDE------LWHTNDNQIAIFNRLKLVP---------  428

S1   708 IQKAQVSGQG DSLHEHIANLAGSPAIKKGILQTVKVVDELVKVMGRHKPENIVIEMAR ENQTT------QK GQKNSRERM  781
S2   712 IQKSQVVGDV DDIEAVVHDLPGSPAIKKGILQSVKIVDELVKVMG-GNPDNIVIEMAR ENQTT------NR GRSQSQQRL  784
S3   707 IQKAQVIGKT DDVKQVVQELSGSPAIKKGILQSIKIVDELVKVMG-HAPESIVIEMAR ENQTT------AR GKKNSQQRY  779
S4   429 -KKVDLSQQK EIPTTLVDDFILSPVVKRSFIQSIKVINAIIKKYG--LPNDIIIELAR EKNSKDAQKMINE MQKRNRQTN  505

S1   782 KRIEEGIKELGSQIL---------KEHPVENTQLQNEKLYLYYLQNGRDMYVDQELDINRLSD----YDVDH*IVPQSFLKD 850
S2   785 KKLQNSLKELGSNILNEEKPSYIEDKVENSHLQNQLFLYYLQNGKDMYTGDELDIDHLSD----YDIDH*IIFQAFIKDQ  860
S3   780 KRIEDSLKILASGL--DSNILKENPTDNNQLQNDRLFLYYLQNGEKDMYTGEALDINQLSS----YDIDE*IIPQAFIKDO 852
S4   506 ERIESIIRTTGK----------------                                                     570
             ENAKYLIEKIKLHDMQEGKCLYSLEAIPLEDLLNNPFNYEVDH*IIPRSVSFDN

S1   851 SIDNKVLTRSDKNRGKSDNVPSEEVVKKMKNYWRQLLNAKLITQRKFDN-LTK AERG QL-SELD------KAGFIKRQLV  922
S2   861 SIDNRVLTSSAKNRGKSDDVPSLDIVRARKAEWVRLYKSGLISKRKFDN-LTK AERG QL-TEAD------KAGFIKRQLV  932
S3   853 SLDNRVLTSSKDNRGKSDNVPSIEVVQKRKAFWQQLLDSKLISERKFNN-LTK AERG QL-DERD------KVGFIKRQLV  924
S4   571 SFNNKVLVKQEEASKKGNRTPFQYLSSSDSKISYETFKKHILNLAKGKGRISK TKKEY LLEERDINRFSVQKDFINRNLV  650

S1   923 ETRQITKHVAQILDSRMNTKYDENDKLIREVKVITLKSKLVSDFRKDFQFYKVREINNYHHAHDAYLNAVVGTALIKKYP 1002
S2   933 ETRQITKHVAQILDARFNTEHDENDKVIRDVKVITLKSNLVSQFRKDFEFYKVREINDYHHAHDAYLNAVVGTALLKKYP 1012
S3   925 ETRQITKHVAQILDARYNTEVNEKDKKNRTVKIITLKSNLVSNFRKEFRLYKVREINDYHHAHDAYLNAVVAKAILKKYP 1004
S4   651 DTRYATRGLMNLLRSYFRVN-------NLDVKVKSINGGFTSFLRRKWKFKKERNKGYKHHAEDALIIA-----------  712

S1  1003 KLESEFVYGDYKVYDVRKMIAKSEQ--EIGKATAKYFFYSNIMNFFRTEITLANGEIRKRPLIETNGETGEIVWDKG--- 1077
S2  1013 KLASEFVYGEYKKYDIRKFITNSSD-----KATAKYFFYSNLMNFFKTKVKYADGTVFERPIIETNAD-GEIAWNKQ--  1083
S3  1005 KLEPEFVYGEYQKYDLKRYISRSKDPKEVEKATEKYFFYSNLLNFFKEEVHYADGTIVKRENIEYSKDTGEIAWNKE--  1081
S4   713 --NADFIFKEWKKLDKAKKVMENQM----------------------FEEKQAESMPEIETEQEYKEIFITPHQIK    764

S1  1078 -----RDFATVRKVLSMPQVNIVKKTEVQI GGFSKESILPKRNSDKLIARKKD---WDPKKYGGFDSPTVAYSVLVVAKV 1149
S2  1084 -----IDFEKVRKVLSYPQVNIVKKVETQI GGFSKESILPKGDSDKLIPKTKKVYWDTKKYGGFDSPTVAYSVFVVADV  1158
S3  1082 -----KDFAIIKKVLSLPQVNIVKKREVQI GGFSKESILPKGNSDKLIPRKTKDILLDTTKYGGFDSPVIAYSILLIAD  1156
S4   765 HIKDFKDYKYSHRVDKKPNRELINDTLYST RKDDKGNTLIVNNLNGLYDKDNDKL----KKLIN-KSP----EKLLMYHH  835

S1  1150 EKGKSKKLKSVKELLGITIMERSSFEKNPI-DFLEAKG-----YKEVKKDLIIKLPKYSLFELENGRKRMLASAGELQKG 1223
S2  1159 EKGKAKKLKTVKELVGISIMERSFFEENPV-EFLENKG-----YHNIREDKLIKLPKYSLFEFEGGRRRLLASAELQKG  1232
S3  1157 EKGKAKKLKTVKTLVGITIMEKAAFEENPI-TFLENKG-----YHNVRKENILCLPKYSLFELENGRRLASAKELQKG   1230
S4   836 DPQTYQKLK--------LIMEQYGDEKNPLYKYYEETGNYLTKYSKKDNGPVIKKIKYYGNKLNAHLDITDDYPN-      907
              SARNKV

S1  1224 NELALPSKLYVNFLYLASHYEKLKGSPEDNEQKQLFVEQHKHYLDEIIEQISEF-                          1297
              SKRVILADANLDKVLSAYNKH------
S2  1233 NEMVLPGYLVELLYHAHRADNF-----NSTEYLNYVSEHKKEFEKVLSCVEDFANLYVDVEKNLSKIRAVADSM------ 1301
S3  1231 NEIVLPVYLTTLLYHSKNVHKL-----DEPGHLEYIQKHRNEFKDLLNLVSEFSQKYVLADANLEKIKSLYADN------ 1299
S4   908 VKLSLKPYRFD-VYLDNGVYKFV-----TVKNLDVIK--KENYYEVNSKAYEEAKKLKKISNQAEFIASFYNNDLIKING  979

S1  1298 RDKPIREQAENIIHLFTLTNLGAPAAFKYFDTTIDRKRYTSTKEVLDATLIHQSIT--------GLYETRI----DLSQL 1365
S2  1302 DNFSIEEISNSFINLTLTALGAPADFNFLGEKIPRKRYTSTKECLNATLIHQSIT--------GLYETRI----DLSKL  1369
S3  1300 EQADIEILANSFINLLTFTALGAPAAFKFFGKDIDRKRYTTVSEILNATLIHQSIT--------GLYETWI----DLSKL 1367
```

```
S4   980 ELYRVIGVNNDLLNRIEVNMIDITYR-EYLENMNDKPPRIIKTIASKT---QSIKKYSTDILGNLYEVSKKHPQIIKK  1055

S1  1366 GGD                                                                          1368
S2  1370 GEE                                                                          1372
S3  1368 GED                                                                          1370
S4  1056 G--                                                                          1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 11-14 (e.g., S1, S2, S3, and S4, respectively) are mutated as described herein. The residues D10 and H840 in Cas9 of SEQ ID NO: 10 that correspond to the residues identified in SEQ ID NOs: 11-14 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 10 herein, e.g., mutations of residues 10, and 840 in SEQ ID NO: 10, are referred to herein as "homologous" or "corresponding" mutations. For example, the mutations corresponding to the D10A mutation in SEQ ID NO: 10 or S1 (SEQ ID NO: 11) for the four aligned sequences above are D11A for S2, D10A for S3, and D13A for S4; the corresponding mutations for H840A in SEQ ID NO: 10 or S1 (SEQ ID NO: 11) are H850A for S2, H842A for S3, and H560A for S4.

A total of 250 Cas9 sequences (SEQ ID NOs: 11-260) from different species were aligned using the same algorithm and alignment parameters outlined above. Amino acid residues homologous to residues 10, and 840 of SEQ ID NO: 10 were identified in the same manner as outlined above. The alignments are provided below. The HNH domain (bold and underlined) and the RuvC domain (boxed) are identified for each of the four sequences. Single residues corresponding to amino acid residues 10, and 840 in SEQ ID NO: 10 are boxed in SEQ ID NO: 11 in the alignments, allowing for the identification of the corresponding amino acid residues in the aligned sequences.

| Accession | Description | SEQ ID |
|---|---|---|
| WP_010922251.1 | type II CRISPR RNA-guided endonuclease Cas9 [Streptococcus pyogenes] | SEQ ID NO: 11 |
| WP_039695303.1 | type II CRISPR RNA-guided endonuclease Cas9 [Streptococcus gallolyticus] | SEQ ID NO: 12 |
| WP_045635197.1 | type II CRISPR RNA-guided endonuclease Cas9 [Streptococcus mitis] | SEQ ID NO: 13 |
| 5AXW_A | Cas9, Chain A, Crystal Structure [Staphylococcus Aureus] | SEQ ID NO: 14 |
| WP_009880683.1 | type II CRISPR RNA-guided endonuclease Cas9 [Streptococcus pyogenes] | SEQ ID NO: 15 |
| WP_010922251.1 | type II CRISPR RNA-guided endonuclease Cas9 [Streptococcus pyogenes] | SEQ ID NO: 16 |
| WP_011054416.1 | type II CRISPR RNA-guided endonuclease Cas9 [Streptococcus pyogenes] | SEQ ID NO: 17 |
| WP_011284745.1 | type II CRISPR RNA-guided endonuclease Cas9 [Streptococcus pyogenes] | SEQ ID NO: 18 |
| WP_011285506.1 | type II CRISPR RNA-guided endonuclease Cas9 [Streptococcus pyogenes] | SEQ ID NO: 19 |
| WP_011527619.1 | type II CRISPR RNA-guided endonuclease Cas9 [Streptococcus pyogenes] | SEQ ID NO: 20 |
| WP_012560673.1 | type II CRISPR RNA-guided endonuclease Cas9 [Streptococcus pyogenes] | SEQ ID NO: 21 |
| WP_014407541.1 | type II CRISPR RNA-guided endonuclease Cas9 [Streptococcus pyogenes] | SEQ ID NO: 22 |
| WP_020905136.1 | type II CRISPR RNA-guided endonuclease Cas9 [Streptococcus pyogenes] | SEQ ID NO: 23 |
| WP_023080005.1 | type II CRISPR RNA-guided endonuclease Cas9 [Streptococcus pyogenes] | SEQ ID NO: 24 |
| WP_023610282.1 | type II CRISPR RNA-guided endonuclease Cas9 [Streptococcus pyogenes] | SEQ ID NO: 25 |
| WP_030125963.1 | type II CRISPR RNA-guided endonuclease Cas9 [Streptococcus pyogenes] | SEQ ID NO: 26 |
| WP_030126706.1 | type II CRISPR RNA-guided endonuclease Cas9 [Streptococcus pyogenes] | SEQ ID NO: 27 |
| WP_031488318.1 | type II CRISPR RNA-guided endonuclease Cas9 [Streptococcus pyogenes] | SEQ ID NO: 28 |
| WP_032460140.1 | type II CRISPR RNA-guided endonuclease Cas9 [Streptococcus pyogenes] | SEQ ID NO: 29 |
| WP_032461047.1 | type II CRISPR RNA-guided endonuclease Cas9 [Streptococcus pyogenes] | SEQ ID NO: 30 |
| WP_032462016.1 | type II CRISPR RNA-guided endonuclease Cas9 [Streptococcus pyogenes] | SEQ ID NO: 31 |
| WP_032462936.1 | type II CRISPR RNA-guided endonuclease Cas9 [Streptococcus pyogenes] | SEQ ID NO: 32 |
| WP_032464890.1 | type II CRISPR RNA-guided endonuclease Cas9 [Streptococcus pyogenes] | SEQ ID NO: 33 |
| WP_033888930.1 | type II CRISPR RNA-guided endonuclease Cas9 [Streptococcus pyogenes] | SEQ ID NO: 34 |
| WP_038431314.1 | type II CRISPR RNA-guided endonuclease Cas9 [Streptococcus pyogenes] | SEQ ID NO: 35 |
| WP_038432938.1 | type II CRISPR RNA-guided endonuclease Cas9 [Streptococcus pyogenes] | SEQ ID NO: 36 |
| WP_038434062.1 | type II CRISPR RNA-guided endonuclease Cas9 [Streptococcus pyogenes] | SEQ ID NO: 37 |
| BAQ51233.1 | CRISPR-associated protein, Csn1 family [Streptococcus pyogenes] | SEQ ID NO: 38 |
| KGE60162.1 | hypothetical protein MGAS2111_0903 [Streptococcus pyogenes MGAS2111] | SEQ ID NO: 39 |
| KGE60856.1 | CRISPR-associated endonuclease protein [Streptococcus pyogenes SS1447] | SEQ ID NO: 40 |
| WP_002989955.1 | MULTISPECIES: type II CRISPR RNA-guided endonuclease Cas9 [Streptococcus] | SEQ ID NO: 41 |
| WP_003030010.1 | MULTISPECIES: type II CRISPR RNA-guided endonuclease Cas9 [Streptococcus] | SEQ ID NO: 42 |
| WP_003065552.1 | MULTISPECIES: type II CRISPR RNA-guided endonuclease Cas9 [Streptococcus] | SEQ ID NO: 43 |
| WP_001040076.1 | type II CRISPR RNA-guided endonuclease Cas9 [Streptococcus agalactiae] | SEQ ID NO: 44 |
| WP_001040078.1 | type II CRISPR RNA-guided endonuclease Cas9 [Streptococcus agalactiae] | SEQ ID NO: 45 |
| WP_001040080.1 | type II CRISPR RNA-guided endonuclease Cas9 [Streptococcus agalactiae] | SEQ ID NO: 46 |
| WP_001040081.1 | type II CRISPR RNA-guided endonuclease Cas9 [Streptococcus agalactiae] | SEQ ID NO: 47 |
| WP_001040083.1 | type II CRISPR RNA-guided endonuclease Cas9 [Streptococcus agalactiae] | SEQ ID NO: 48 |
| WP_001040085.1 | type II CRISPR RNA-guided endonuclease Cas9 [Streptococcus agalactiae] | SEQ ID NO: 49 |
| WP_001040087.1 | type II CRISPR RNA-guided endonuclease Cas9 [Streptococcus agalactiae] | SEQ ID NO: 50 |
| WP_001040088.1 | type II CRISPR RNA-guided endonuclease Cas9 [Streptococcus agalactiae] | SEQ ID NO: 51 |
| WP_001040089.1 | type II CRISPR RNA-guided endonuclease Cas9 [Streptococcus agalactiae] | SEQ ID NO: 52 |
| WP_001040090.1 | type II CRISPR RNA-guided endonuclease Cas9 [Streptococcus agalactiae] | SEQ ID NO: 53 |
| WP_001040091.1 | type II CRISPR RNA-guided endonuclease Cas9 [Streptococcus agalactiae] | SEQ ID NO: 54 |
| WP_001040092.1 | type II CRISPR RNA-guided endonuclease Cas9 [Streptococcus agalactiae] | SEQ ID NO: 55 |
| WP_001040094.1 | type II CRISPR RNA-guided endonuclease Cas9 [Streptococcus agalactiae] | SEQ ID NO: 56 |
| WP_001040095.1 | type II CRISPR RNA-guided endonuclease Cas9 [Streptococcus agalactiae] | SEQ ID NO: 57 |
| WP_001040096.1 | type II CRISPR RNA-guided endonuclease Cas9 [Streptococcus agalactiae] | SEQ ID NO: 58 |
| WP_001040097.1 | type II CRISPR RNA-guided endonuclease Cas9 [Streptococcus agalactiae] | SEQ ID NO: 59 |
| WP_001040098.1 | type II CRISPR RNA-guided endonuclease Cas9 [Streptococcus agalactiae] | SEQ ID NO: 60 |
| WP_001040099.1 | type II CRISPR RNA-guided endonuclease Cas9 [Streptococcus agalactiae] | SEQ ID NO: 61 |
| WP_001040100.1 | type II CRISPR RNA-guided endonuclease Cas9 [Streptococcus agalactiae] | SEQ ID NO: 62 |

| Accession | Description | SEQ ID NO |
|---|---|---|
| WP_001040104.1 | type II CRISPR RNA-guided endonuclease Cas9 [Streptococcus agalactiae] | SEQ ID NO: 63 |
| WP_001040105.1 | type II CRISPR RNA-guided endonuclease Cas9 [Streptococcus agalactiae] | SEQ ID NO: 64 |
| WP_001040106.1 | type II CRISPR RNA-guided endonuclease Cas9 [Streptococcus agalactiae] | SEQ ID NO: 65 |
| WP_001040107.1 | type II CRISPR RNA-guided endonuclease Cas9 [Streptococcus agalactiae] | SEQ ID NO: 66 |
| WP_001040108.1 | type II CRISPR RNA-guided endonuclease Cas9 [Streptococcus agalactiae] | SEQ ID NO: 67 |
| WP_001040109.1 | type II CRISPR RNA-guided endonuclease Cas9 [Streptococcus agalactiae] | SEQ ID NO: 68 |
| WP_001040110.1 | type II CRISPR RNA-guided endonuclease Cas9 [Streptococcus agalactiae] | SEQ ID NO: 69 |
| WP_015058523.1 | type II CRISPR RNA-guided endonuclease Cas9 [Streptococcus agalactiae] | SEQ ID NO: 70 |
| WP_017643650.1 | type II CRISPR RNA-guided endonuclease Cas9 [Streptococcus agalactiae] | SEQ ID NO: 71 |
| WP_017647151.1 | type II CRISPR RNA-guided endonuclease Cas9 [Streptococcus agalactiae] | SEQ ID NO: 72 |
| WP_017648376.1 | type II CRISPR RNA-guided endonuclease Cas9 [Streptococcus agalactiae] | SEQ ID NO: 73 |
| WP_017649527.1 | type II CRISPR RNA-guided endonuclease Cas9 [Streptococcus agalactiae] | SEQ ID NO: 74 |
| WP_017771611.1 | type II CRISPR RNA-guided endonuclease Cas9 [Streptococcus agalactiae] | SEQ ID NO: 75 |
| WP_017771984.1 | type II CRISPR RNA-guided endonuclease Cas9 [Streptococcus agalactiae] | SEQ ID NO: 76 |
| CFQ25032.1 | CRISPR-associated protein [Streptococcus agalactiae] | SEQ ID NO: 77 |
| CFV16040.1 | CRISPR-associated protein [Streptococcus agalactiae] | SEQ ID NO: 78 |
| KLJ37842.1 | CRISPR-associated protein Csn1 [Streptococcus agalactiae] | SEQ ID NO: 79 |
| KLJ72361.1 | CRISPR-associated protein Csn1 [Streptococcus agalactiae] | SEQ ID NO: 80 |
| KLL20707.1 | CRISPR-associated protein Csn1 [Streptococcus agalactiae] | SEQ ID NO: 81 |
| KLL42645.1 | CRISPR-associated protein Csn1 [Streptococcus agalactiae] | SEQ ID NO: 82 |
| WP_047207273.1 | type II CRISPR RNA-guided endonuclease Cas9 [Streptococcus agalactiae] | SEQ ID NO: 83 |
| WP_047209694.1 | type II CRISPR RNA-guided endonuclease Cas9 [Streptococcus agalactiae] | SEQ ID NO: 84 |
| WP_050198062.1 | type II CRISPR RNA-guided endonuclease Cas9 [Streptococcus agalactiae] | SEQ ID NO: 85 |
| WP_050201642.1 | type II CRISPR RNA-guided endonuclease Cas9 [Streptococcus agalactiae] | SEQ ID NO: 86 |
| WP_050204027.1 | type II CRISPR RNA-guided endonuclease Cas9 [Streptococcus agalactiae] | SEQ ID NO: 87 |
| WP_050881965.1 | type II CRISPR RNA-guided endonuclease Cas9 [Streptococcus agalactiae] | SEQ ID NO: 88 |
| WP_050886065.1 | type II CRISPR RNA-guided endonuclease Cas9 [Streptococcus agalactiae] | SEQ ID NO: 89 |
| AHN30376.1 | CRISPR-associated protein Csn1 [Streptococcus agalactiae 138P] | SEQ ID NO: 90 |
| EAO78426.1 | reticulocyte binding protein [Streptococcus agalactiae H36B] | SEQ ID NO: 91 |
| CCW42055.1 | CRISPR-associated protein, SAG0894 family [Streptococcus agalactiae ILRI112] | SEQ ID NO: 92 |
| WP_003041502.1 | type II CRISPR RNA-guided endonuclease Cas9 [Streptococcus anginosus] | SEQ ID NO: 93 |
| WP_037593752.1 | type II CRISPR RNA-guided endonuclease Cas9 [Streptococcus anginosus] | SEQ ID NO: 94 |
| WP_049516684.1 | CRISPR-associated protein Csn1 [Streptococcus anginosus] | SEQ ID NO: 95 |
| GAD46167.1 | hypothetical protein ANG6_0662 [Streptococcus anginosus T5] | SEQ ID NO: 96 |
| WP_018363470.1 | type II CRISPR RNA-guided endonuclease Cas9 [Streptococcus caballi] | SEQ ID NO: 97 |
| WP_003043819.1 | type II CRISPR RNA-guided endonuclease Cas9 [Streptococcus canis] | SEQ ID NO: 98 |
| WP_006269658.1 | type II CRISPR RNA-guided endonuclease Cas9 [Streptococcus constellatus] | SEQ ID NO: 99 |
| WP_048800889.1 | type II CRISPR RNA-guided endonuclease Cas9 [Streptococcus constellatus] | SEQ ID NO: 100 |
| WP_012767106.1 | type II CRISPR RNA-guided endonuclease Cas9 [Streptococcus dysgalactiae] | SEQ ID NO: 101 |
| WP_014612333.1 | type II CRISPR RNA-guided endonuclease Cas9 [Streptococcus dysgalactiae] | SEQ ID NO: 102 |
| WP_015017095.1 | type II CRISPR RNA-guided endonuclease Cas9 [Streptococcus dysgalactiae] | SEQ ID NO: 103 |
| WP_015057649.1 | type II CRISPR RNA-guided endonuclease Cas9 [Streptococcus dysgalactiae] | SEQ ID NO: 104 |
| WP_048327215.1 | type II CRISPR RNA-guided endonuclease Cas9 [Streptococcus dysgalactiae] | SEQ ID NO: 105 |
| WP_049519324.1 | CRISPR-associated protein Csn1 [Streptococcus dysgalactiae] | SEQ ID NO: 106 |
| WP_012515931.1 | type II CRISPR RNA-guided endonuclease Cas9 [Streptococcus equi] | SEQ ID NO: 107 |
| WP_021320964.1 | type II CRISPR RNA-guided endonuclease Cas9 [Streptococcus equi] | SEQ ID NO: 108 |
| WP_037581760.1 | type II CRISPR RNA-guided endonuclease Cas9 [Streptococcus equi] | SEQ ID NO: 109 |
| WP_044232481.1 | type II CRISPR RNA-guided endonuclease Cas9 [Streptococcus equinus] | SEQ ID NO: 110 |
| WP_009854540.1 | type II CRISPR RNA-guided endonuclease Cas9 [Streptococcus gallolyticus] | SEQ ID NO: 111 |
| WP_012962174.1 | type II CRISPR RNA-guided endonuclease Cas9 [Streptococcus gallolyticus] | SEQ ID NO: 112 |
| WP_039695303.1 | type II CRISPR RNA-guided endonuclease Cas9 [Streptococcus gallolyticus] | SEQ ID NO: 113 |
| WP_014334983.1 | type II CRISPR RNA-guided endonuclease Cas9 [Streptococcus infantarius] | SEQ ID NO: 114 |
| WP_003099269.1 | type II CRISPR RNA-guided endonuclease Cas9 [Streptococcus iniae] | SEQ ID NO: 115 |

| Accession | Description | SEQ ID NO |
|---|---|---|
| AHY15608.1 | CRISPR-associated protein Csn1 [Streptococcus iniae] | SEQ ID NO: 116 |
| AHY17476.1 | CRISPR-associated protein Csn1 [Streptococcus iniae] | SEQ ID NO: 117 |
| ESR09100.1 | hypothetical protein IUSA1_08595 [Streptococcus iniae IUSA1] | SEQ ID NO: 118 |
| AGM98575.1 | CRISPR-associated protein Cas9/Csn1, subtype II/NMEMI [Streptococcus iniae SF1] | SEQ ID NO: 119 |
| ALF27331.1 | CRISPR-associated protein Csn1 [Streptococcus intermedius] | SEQ ID NO: 120 |
| WP_018372492.1 | type II CRISPR RNA-guided endonuclease Cas9 [Streptococcus massiliensis] | SEQ ID NO: 121 |
| WP_045618028.1 | type II CRISPR RNA-guided endonuclease Cas9 [Streptococcus mitis] | SEQ ID NO: 122 |
| WP_045635197.1 | type II CRISPR RNA-guided endonuclease Cas9 [Streptococcus mitis] | SEQ ID NO: 123 |
| WP_002263549.1 | type II CRISPR RNA-guided endonuclease Cas9 [Streptococcus mutans] | SEQ ID NO: 124 |
| WP_002263887.1 | type II CRISPR RNA-guided endonuclease Cas9 [Streptococcus mutans] | SEQ ID NO: 125 |
| WP_002264920.1 | type II CRISPR RNA-guided endonuclease Cas9 [Streptococcus mutans] | SEQ ID NO: 126 |
| WP_002269043.1 | type II CRISPR RNA-guided endonuclease Cas9 [Streptococcus mutans] | SEQ ID NO: 127 |
| WP_002269448.1 | type II CRISPR RNA-guided endonuclease Cas9 [Streptococcus mutans] | SEQ ID NO: 128 |
| WP_002271977.1 | type II CRISPR RNA-guided endonuclease Cas9 [Streptococcus mutans] | SEQ ID NO: 129 |
| WP_002272766.1 | type II CRISPR RNA-guided endonuclease Cas9 [Streptococcus mutans] | SEQ ID NO: 130 |
| WP_002273241.1 | type II CRISPR RNA-guided endonuclease Cas9 [Streptococcus mutans] | SEQ ID NO: 131 |
| WP_002275430.1 | type II CRISPR RNA-guided endonuclease Cas9 [Streptococcus mutans] | SEQ ID NO: 132 |
| WP_002276448.1 | type II CRISPR RNA-guided endonuclease Cas9 [Streptococcus mutans] | SEQ ID NO: 133 |
| WP_002277050.1 | type II CRISPR RNA-guided endonuclease Cas9 [Streptococcus mutans] | SEQ ID NO: 134 |
| WP_002277364.1 | type II CRISPR RNA-guided endonuclease Cas9 [Streptococcus mutans] | SEQ ID NO: 135 |
| WP_002279025.1 | type II CRISPR RNA-guided endonuclease Cas9 [Streptococcus mutans] | SEQ ID NO: 136 |
| WP_002279859.1 | type II CRISPR RNA-guided endonuclease Cas9 [Streptococcus mutans] | SEQ ID NO: 137 |
| WP_002280230.1 | type II CRISPR RNA-guided endonuclease Cas9 [Streptococcus mutans] | SEQ ID NO: 138 |
| WP_002281696.1 | type II CRISPR RNA-guided endonuclease Cas9 [Streptococcus mutans] | SEQ ID NO: 139 |
| WP_002282247.1 | type II CRISPR RNA-guided endonuclease Cas9 [Streptococcus mutans] | SEQ ID NO: 140 |
| WP_002282906.1 | type II CRISPR RNA-guided endonuclease Cas9 [Streptococcus mutans] | SEQ ID NO: 141 |
| WP_002283846.1 | type II CRISPR RNA-guided endonuclease Cas9 [Streptococcus mutans] | SEQ ID NO: 142 |
| WP_002287255.1 | type II CRISPR RNA-guided endonuclease Cas9 [Streptococcus mutans] | SEQ ID NO: 143 |
| WP_002288990.1 | type II CRISPR RNA-guided endonuclease Cas9 [Streptococcus mutans] | SEQ ID NO: 144 |
| WP_002289641.1 | type II CRISPR RNA-guided endonuclease Cas9 [Streptococcus mutans] | SEQ ID NO: 145 |
| WP_002290427.1 | type II CRISPR RNA-guided endonuclease Cas9 [Streptococcus mutans] | SEQ ID NO: 146 |
| WP_002295753.1 | type II CRISPR RNA-guided endonuclease Cas9 [Streptococcus mutans] | SEQ ID NO: 147 |
| WP_002296423.1 | type II CRISPR RNA-guided endonuclease Cas9 [Streptococcus mutans] | SEQ ID NO: 148 |
| WP_002304487.1 | type II CRISPR RNA-guided endonuclease Cas9 [Streptococcus mutans] | SEQ ID NO: 149 |
| WP_002305844.1 | type II CRISPR RNA-guided endonuclease Cas9 [Streptococcus mutans] | SEQ ID NO: 150 |
| WP_002307203.1 | type II CRISPR RNA-guided endonuclease Cas9 [Streptococcus mutans] | SEQ ID NO: 151 |
| WP_002310390.1 | type II CRISPR RNA-guided endonuclease Cas9 [Streptococcus mutans] | SEQ ID NO: 152 |
| WP_002352408.1 | type II CRISPR RNA-guided endonuclease Cas9 [Streptococcus mutans] | SEQ ID NO: 153 |
| WP_012997688.1 | type II CRISPR RNA-guided endonuclease Cas9 [Streptococcus mutans] | SEQ ID NO: 154 |
| WP_014677909.1 | type II CRISPR RNA-guided endonuclease Cas9 [Streptococcus mutans] | SEQ ID NO: 155 |
| WP_019312892.1 | type II CRISPR RNA-guided endonuclease Cas9 [Streptococcus mutans] | SEQ ID NO: 156 |
| WP_019313659.1 | type II CRISPR RNA-guided endonuclease Cas9 [Streptococcus mutans] | SEQ ID NO: 157 |
| WP_019314093.1 | type II CRISPR RNA-guided endonuclease Cas9 [Streptococcus mutans] | SEQ ID NO: 158 |
| WP_019315370.1 | type II CRISPR RNA-guided endonuclease Cas9 [Streptococcus mutans] | SEQ ID NO: 159 |
| WP_019803776.1 | type II CRISPR RNA-guided endonuclease Cas9 [Streptococcus mutans] | SEQ ID NO: 160 |
| WP_019805234.1 | type II CRISPR RNA-guided endonuclease Cas9 [Streptococcus mutans] | SEQ ID NO: 161 |
| WP_024783594.1 | type II CRISPR RNA-guided endonuclease Cas9 [Streptococcus mutans] | SEQ ID NO: 162 |
| WP_024784288.1 | type II CRISPR RNA-guided endonuclease Cas9 [Streptococcus mutans] | SEQ ID NO: 163 |
| WP_024784666.1 | type II CRISPR RNA-guided endonuclease Cas9 [Streptococcus mutans] | SEQ ID NO: 164 |
| WP_024784894.1 | type II CRISPR RNA-guided endonuclease Cas9 [Streptococcus mutans] | SEQ ID NO: 165 |
| WP_024786433.1 | type II CRISPR RNA-guided endonuclease Cas9 [Streptococcus mutans] | SEQ ID NO: 166 |
| WP_049473442.1 | CRISPR-associated protein Csn1 [Streptococcus mutans] | SEQ ID NO: 167 |
| WP_049474547.1 | CRISPR-associated protein Csn1 [Streptococcus mutans] | SEQ ID NO: 168 |

-continued

| | | |
|---|---|---|
| EMC03581.1 | hypothetical protein SMU69_09359 [Streptococcus mutans NLML4] | SEQ ID NO: 169 |
| WP_000428812.1 | type II CRISPR RNA-guided endonuclease Cas9 [Streptococcus oralis] | SEQ ID NO: 170 |
| WP_000428613.1 | type II CRISPR RNA-guided endonuclease Cas9 [Streptococcus oralis] | SEQ ID NO: 171 |
| WP_049523028.1 | CRISPR-associated protein Csn1 [Streptococcus parasanguinis] | SEQ ID NO: 172 |
| WP_003107102.1 | type II CRISPR RNA-guided endonuclease Cas9 [Streptococcus parauberis] | SEQ ID NO: 173 |
| WP_054279288.1 | type II CRISPR RNA-guided endonuclease Cas9 [Streptococcus phocae] | SEQ ID NO: 174 |
| WP_049531101.1 | CRISPR-associated protein Csn1 [Streptococcus pseudopneumoniae] | SEQ ID NO: 175 |
| WP_049538452.1 | CRISPR-associated protein Csn1 [Streptococcus pseudopneumoniae] | SEQ ID NO: 176 |
| WP_049549711.1 | CRISPR-associated protein Csn1 [Streptococcus pseudopneumoniae] | SEQ ID NO: 177 |
| WP_007896501.1 | type II CRISPR RNA-guided endonuclease Cas9 [Streptococcus pseudoporcinus] | SEQ ID NO: 178 |
| EFR44625.1 | CRISPR-associated protein, Csn1 family [Streptococcus pseudoporcinus SPIN 20026] | SEQ ID NO: 179 |
| WP_002897477.1 | type II CRISPR RNA-guided endonuclease Cas9 [Streptococcus sanguinis] | SEQ ID NO: 180 |
| WP_002906454.1 | type II CRISPR RNA-guided endonuclease Cas9 [Streptococcus sanguinis] | SEQ ID NO: 181 |
| WP_009729476.1 | type II CRISPR RNA-guided endonuclease Cas9 [Streptococcus sp. F0441] | SEQ ID NO: 182 |
| CQR24647.1 | CRISPR-associated protein [Streptococcus sp. FF10] | SEQ ID NO: 183 |
| WP_000066813.1 | type II CRISPR RNA-guided endonuclease Cas9 [Streptococcus sp. M334] | SEQ ID NO: 184 |
| WP_009754323.1 | type II CRISPR RNA-guided endonuclease Cas9 [Streptococcus sp. taxon 056] | SEQ ID NO: 185 |
| WP_044674937.1 | type II CRISPR RNA-guided endonuclease Cas9 [Streptococcus suis] | SEQ ID NO: 186 |
| WP_044676715.1 | type II CRISPR RNA-guided endonuclease Cas9 [Streptococcus suis] | SEQ ID NO: 187 |
| WP_044680361.1 | type II CRISPR RNA-guided endonuclease Cas9 [Streptococcus suis] | SEQ ID NO: 188 |
| WP_044681799.1 | type II CRISPR RNA-guided endonuclease Cas9 [Streptococcus suis] | SEQ ID NO: 189 |
| WP_049533112.1 | CRISPR-associated protein Csn1 [Streptococcus suis] | SEQ ID NO: 190 |
| WP_029090905.1 | type II CRISPR RNA-guided endonuclease Cas9 [Brochothrix thermosphacta] | SEQ ID NO: 191 |
| WP_006506696.1 | type II CRISPR RNA-guided endonuclease Cas9 [Catenibacterium mitsuokai] | SEQ ID NO: 192 |
| AIT42264.1 | Cas9hc:NLS:HA [Cloning vector pYB196] | SEQ ID NO: 193 |
| WP_034440723.1 | type II CRISPR endonuclease Cas9 [Clostridiales bacterium S5-A11] | SEQ ID NO: 194 |
| AKQ21048.1 | Cas9 [CRISPR-mediated gene targeting vector p(bh5p68-Cas9)] | SEQ ID NO: 195 |
| WP_002364836.1 | type II CRISPR RNA-guided endonuclease Cas9 [Dolosigranulum pigrum] | SEQ ID NO: 196 |
| WP_016631044.1 | MULTISPECIES: type II CRISPR RNA-guided endonuclease Cas9 [Enterococcus] | SEQ ID NO: 197 |
| | MULTISPECIES: type II CRISPR RNA-guided endonuclease Cas9 [Enterococcus] | SEQ ID NO: 198 |
| EMS75795.1 | hypothetical protein H318_06676 [Enterococcus durans IPLA 655] | SEQ ID NO: 199 |
| WP_002373311.1 | type II CRISPR RNA-guided endonuclease Cas9 [Enterococcus faecalis] | SEQ ID NO: 200 |
| WP_002378009.1 | type II CRISPR RNA-guided endonuclease Cas9 [Enterococcus faecalis] | SEQ ID NO: 201 |
| WP_002407324.1 | type II CRISPR RNA-guided endonuclease Cas9 [Enterococcus faecalis] | SEQ ID NO: 202 |
| WP_002413717.1 | type II CRISPR RNA-guided endonuclease Cas9 [Enterococcus faecalis] | SEQ ID NO: 203 |
| WP_010775580.1 | type II CRISPR RNA-guided endonuclease Cas9 [Enterococcus faecalis] | SEQ ID NO: 204 |
| WP_010818269.1 | type II CRISPR RNA-guided endonuclease Cas9 [Enterococcus faecalis] | SEQ ID NO: 205 |
| WP_010824395.1 | type II CRISPR RNA-guided endonuclease Cas9 [Enterococcus faecalis] | SEQ ID NO: 206 |
| WP_016622645.1 | type II CRISPR RNA-guided endonuclease Cas9 [Enterococcus faecalis] | SEQ ID NO: 207 |
| WP_033624816.1 | type II CRISPR RNA-guided endonuclease Cas9 [Enterococcus faecalis] | SEQ ID NO: 208 |
| WP_033625576.1 | type II CRISPR RNA-guided endonuclease Cas9 [Enterococcus faecalis] | SEQ ID NO: 209 |
| WP_033789179.1 | type II CRISPR RNA-guided endonuclease Cas9 [Enterococcus faecalis] | SEQ ID NO: 210 |
| WP_002310644.1 | type II CRISPR RNA-guided endonuclease Cas9 [Enterococcus faecium] | SEQ ID NO: 211 |
| WP_002312694.1 | type II CRISPR RNA-guided endonuclease Cas9 [Enterococcus faecium] | SEQ ID NO: 212 |
| WP_002314015.1 | type II CRISPR RNA-guided endonuclease Cas9 [Enterococcus faecium] | SEQ ID NO: 213 |
| WP_002320716.1 | type II CRISPR RNA-guided endonuclease Cas9 [Enterococcus faecium] | SEQ ID NO: 214 |
| WP_002330729.1 | type II CRISPR RNA-guided endonuclease Cas9 [Enterococcus faecium] | SEQ ID NO: 215 |
| WP_002335161.1 | type II CRISPR RNA-guided endonuclease Cas9 [Enterococcus faecium] | SEQ ID NO: 216 |
| WP_002345439.1 | type II CRISPR RNA-guided endonuclease Cas9 [Enterococcus faecium] | SEQ ID NO: 217 |
| WP_034867970.1 | type II CRISPR RNA-guided endonuclease Cas9 [Enterococcus faecium] | SEQ ID NO: 218 |
| WP_047937432.1 | type II CRISPR RNA-guided endonuclease Cas9 [Enterococcus faecium] | SEQ ID NO: 219 |
| WP_010720994.1 | type II CRISPR RNA-guided endonuclease Cas9 [Enterococcus hirae] | SEQ ID NO: 220 |
| WP_010737004.1 | type II CRISPR RNA-guided endonuclease Cas9 [Enterococcus hirae] | SEQ ID NO: 221 |

| Accession | Description | SEQ ID NO |
|---|---|---|
| WP_034700478.1 | type II CRISPR RNA-guided endonuclease Cas9 [Enterococcus hirae] | SEQ ID NO: 222 |
| WP_007209003.1 | type II CRISPR RNA-guided endonuclease Cas9 [Enterococcus italicus] | SEQ ID NO: 223 |
| WP_023519017.1 | type II CRISPR RNA-guided endonuclease Cas9 [Enterococcus mundtii] | SEQ ID NO: 224 |
| WP_010770040.1 | type II CRISPR RNA-guided endonuclease Cas9 [Enterococcus phoeniculicola] | SEQ ID NO: 225 |
| WP_048604708.1 | type II CRISPR RNA-guided endonuclease Cas9 [Enterococcus sp. AM1] | SEQ ID NO: 226 |
| WP_010750235.1 | type II CRISPR RNA-guided endonuclease Cas9 [Enterococcus villorum] | SEQ ID NO: 227 |
| AII16583.1 | Cas9 endonuclease [Expression vector pCas9] | SEQ ID NO: 228 |
| WP_029073316.1 | type II CRISPR RNA-guided endonuclease Cas9 [Kandleria vitulina] | SEQ ID NO: 229 |
| WP_031589969.1 | type II CRISPR RNA-guided endonuclease Cas9 [Kandleria vitulina] | SEQ ID NO: 230 |
| KDA45870.1 | CRISPR-associated protein Cas9/Csn1, subtype II/NMEMI [Lactobacillus animalis] | SEQ ID NO: 231 |
| WP_039099354.1 | type II CRISPR RNA-guided endonuclease Cas9 [Lactobacillus curvatus] | SEQ ID NO: 232 |
| AKP02966.1 | hypothetical protein ABB45_04605 [Lactobacillus farciminis] | SEQ ID NO: 233 |
| WP_010991369.1 | type II CRISPR RNA-guided endonuclease Cas9 [Listeria innocua] | SEQ ID NO: 234 |
| WP_033838504.1 | type II CRISPR RNA-guided endonuclease Cas9 [Listeria innocua] | SEQ ID NO: 235 |
| EHN60060.1 | CRISPR-associated protein, Csn1 family [Listeria innocua ATCC 33091] | SEQ ID NO: 236 |
| EFR89594.1 | crispr-associated protein, Csn1 family [Listeria innocua FSL S4-378] | SEQ ID NO: 237 |
| WP_038409211.1 | type II CRISPR RNA-guided endonuclease Cas9 [Listeria ivanovii] | SEQ ID NO: 238 |
| EFR95520.1 | crispr-associated protein Csn1 [Listeria ivanovii FSL F6-596] | SEQ ID NO: 239 |
| WP_003723650.1 | type II CRISPR RNA-guided endonuclease Cas9 [Listeria monocytogenes] | SEQ ID NO: 240 |
| WP_003727705.1 | type II CRISPR RNA-guided endonuclease Cas9 [Listeria monocytogenes] | SEQ ID NO: 241 |
| WP_003730785.1 | type II CRISPR RNA-guided endonuclease Cas9 [Listeria monocytogenes] | SEQ ID NO: 242 |
| WP_003733029.1 | type II CRISPR RNA-guided endonuclease Cas9 [Listeria monocytogenes] | SEQ ID NO: 243 |
| WP_003739838.1 | type II CRISPR RNA-guided endonuclease Cas9 [Listeria monocytogenes] | SEQ ID NO: 244 |
| WP_014601172.1 | type II CRISPR RNA-guided endonuclease Cas9 [Listeria monocytogenes] | SEQ ID NO: 245 |
| WP_023548323.1 | type II CRISPR RNA-guided endonuclease Cas9 [Listeria monocytogenes] | SEQ ID NO: 246 |
| WP_031665337.1 | type II CRISPR RNA-guided endonuclease Cas9 [Listeria monocytogenes] | SEQ ID NO: 247 |
| WP_031669209.1 | type II CRISPR RNA-guided endonuclease Cas9 [Listeria monocytogenes] | SEQ ID NO: 248 |
| WP_033920898.1 | type II CRISPR RNA-guided endonuclease Cas9 [Listeria monocytogenes] | SEQ ID NO: 249 |
| AKI42028.1 | CRISPR-associated protein [Listeria monocytogenes] | SEQ ID NO: 250 |
| AKI50529.1 | CRISPR-associated protein [Listeria monocytogenes] | SEQ ID NO: 251 |
| EFR83390.1 | crispr-associated protein Csn1 [Listeria monocytogenes FSL F2-208] | SEQ ID NO: 252 |
| WP_046323366.1 | type II CRISPR RNA-guided endonuclease Cas9 [Listeria seeligeri] | SEQ ID NO: 253 |
| AKE81011.1 | Cas9 [Plant multiplex genome editing vector pYLCRISPR/Cas9Pubi-H] | SEQ ID NO: 254 |
| CU082355.1 | Uncharacterized protein conserved in bacteria [Roseburia hominis] | SEQ ID NO: 255 |
| WP_033162887.1 | type II CRISPR RNA-guided endonuclease Cas9 [Sharpea azabuensis] | SEQ ID NO: 256 |
| AGZ01981.1 | Cas9 endonuclease [synthetic construct] | SEQ ID NO: 257 |
| AKA60242.1 | nuclease deficient Cas9 [synthetic construct] | SEQ ID NO: 258 |
| AK540380.1 | Cas9 [Synthetic plasmid pFC330] | SEQ ID NO: 259 |
| 4UN5_B | Cas9, Chain B, Crystal Structure | SEQ ID NO: 260 |

| Accession | | Sequence | SEQ ID NO |
|---|---|---|---|
| WP_010922251 | 1 | MDKK-YSIGLDIGTNSVGWAVITDEYKVPSKKFKVLGNTDRHSIKKNLIGALLFDSGET-EATRLKRTARRYT | 73 |
| WP_039695303 | 1 | MTKKnYSIGLDIGTNSVGWAVITDDYKVPAKKMKVLGNTDKKYIKKNLLIGALLFDSGETA-EATRLKRTARRYT | 74 |
| WP_045635197 | 1 | K-KG-YSIGLDIGTNSVGFAVITDDYKVPSKKMKVLGNTDKRFIKKNLIGALLFDEGTTA-EARRLKRTARRYT | 73 |
| 5AXW_A | 1 | MKRN-YIILGLDIGITSVGYGII--------DYET------------------------------ | 61 |
| WP_009880683 | 1 | ---------------------------------------------------------------- | |
| WP_010922251 | 1 | MDKK-YSIGLDIGTNSVGWAVITDDYKVPSKKFKVLGNTDRHSIKKNLIGALLFDSGETA-EATRLKRTARRYT | 73 |
| WP_011054416 | 1 | MDKK-YSIGLDIGTNSVGWAVITDDYKVPSKKLKGLGNTDRHGIKKNLIGALLFDSGETA-EATRLKRTARRYT | 73 |
| WP_011284745 | 1 | MDKK-YSIGLDIGTNSVGWAVITDDYKVPSKKFKVLGNTDRHSIKKNLIGALLFDSGETA-EATRLKRTARRYT | 73 |
| WP_011285506 | 1 | MDKK-YSIGLDIGTNSVGWAVITDDYKVPSKKFKVLGNTDRHSIKKNLIGALLFDSGETA-EATRLKRTARRYT | 73 |
| WP_011527619 | 1 | MDKK-YSIGLDIGTNSVGWAVITDDYKVPSKKFKVLGNTDRHSIKKNLIGALLFDSGEIA-EATRLKRTARRYT | 73 |
| WP_012560673 | 1 | MDKK-YSIGLDIGTNSVGWAVITDDYKVPSKKFKVLGNTDRHSIKKNLIGALLFGSGETA-EATRLKRTARRYT | 73 |
| WP_014407541 | 1 | MDKK-YSIGLDIGTNSVGWAVITDDYKVPSKKFKVLGNTDRHSIKKNLIGALLFDSGGETA-EATRLKRTARRYT | 73 |
| WP_020905136 | 1 | MDKK-YSIGLDIGTNSVGWAVITDDYKVPSKKFKVLGNTDRHSIKKNLIGALLFDSGETA-EATRLKRTARRYT | 73 |

| | | |
|---|---|---|
| WP_023080005 | 1 MDKK-YSIGLDIGTNSVGWAVITDDYKVPSKKLKVLGNTDRHGIKKNLIGALLFDSGETA--EATRLKRTARRRYT | 73 |
| WP_023610282 | 1 MDKK-YSIGLDIGTNSVGWAVITDDYKVPSKKLKVLGNTDRHGIKKNLIGALLFDSGETA--EATRLKRTARRRYT | 73 |
| WP_030125963 | 1 MDKK-YSIGLDIGTNSVGWAVITDDYKVPSKKFPKVLGNTDRHSIKKNLIGALLFDSGETA--EATRLKRTARRRYT | 73 |
| WP_030126706 | 1 MDKK-YSIGLDIGTNSVGWAVITDDYKVPSKKFPKVLGNTDRHGIKKNLIGALLFDSGETA--EATRLKRTARRRYT | 73 |
| WP_031488318 | 1 MDKK-YSIGLDIGTNSVGWAVITDDYKVPSKKFPKVLGNTDRHSIKKNLIGALLFDSGETA--EATRLKRTARRRYT | 73 |
| WP_032460140 | 1 MDKK-YSIGLDIGTNSVGWAVITDDYKVPSKKFPKVLGNTDRHSIKKNLIGALLFDSGETA--EATRLKRTARRRYT | 73 |
| WP_032461047 | 1 MDKK-YSIGLDIGTNSVGWAVITDDYKVPSKKFPKVLGNTERHSIKKNLIGALLFDSGETA--EATRLKRTARRRYT | 73 |
| WP_032462016 | 1 MDKK-YSIGLDIGTNSVGWAVITDDYKVPSKKFPKVLGNTDRHSIKKNLIGALLFDSGETA--EATRLKRTARRRYT | 73 |
| WP_032462936 | 1 MDKK-YSIGLDIGTNSVGWAVITDDYKVPSKKFPKVLGNTERHSIKKNLIGALLFDSGEIA--EATRLKRTARRRYT | 73 |
| WP_032464890 | 1 MDKK-YSIGLDIGTNSVGWAVITDDYKVPSKKFPKVLGNTERHSIKKNLIGALLFDSGETA--EATRLKRTARRRYT | 73 |
| WP_033888930 | 1 ----------------------------------------------------------------------------- | |
| WP_038431314 | 1 MDKK-YSIGLDIGTNSVGWAVITDDYKVPSKKFPKVLGNTDRHSIKKNLIGALLFDSGETA--EATRLKRTARRRYT | 73 |
| WP_038432938 | 1 MDKK-YSIGLDIGTNSVGWAVITDDYKVPSKKFPKVLGNTDRHSIKKNLIGALLFDSGETA--EATRLKRTARRRYT | 73 |
| WP_038434062 | 1 MDKK-YSIGLDIGTNSVGWAVITDDYKVPSKKFPKVLGNTDRHSIKKNLIGALLFDSGETA--EATRLKRTARRRYT | 73 |
| BAQ51233 | 1 ----------------------------------------------------------------------------- | |
| KGE60162 | 1 ----------------------------------------------------------------------------- | |
| KGE60856 | 1 ----------------------------------------------------------------------------- | |
| WP_002989955 | 1 MDKK-YSIGLDIGTNSVGWAVITDDYKVPAKKMKVLGNTDKQSIKKNLLGALLFDSGETA--EATRLKRTARRRYT | 73 |
| WP_003030002 | 1 MDQK-YSIGLDIGTNSVGWAVVTDDYKVPAKKMKVLGNTDKQSIKKNLLGALLFDSGETA--EATRLKRTARRRYT | 73 |
| WP_003065552 | 1 MTTKnYSIGLDIGTNSVGWAVITDDYKKYIKKNLLGNLIGALLFDSGETA--EATRLKRTARRRYT | 74 |
| WP_001040076 | 1 MNKP-YSIGLDIGTNSVGWSIITDDYKVPAKKIRVLGNTDKEYIKKNLIGALLFDSGNTA--ADRRLKRTARRRYT | 73 |
| WP_001040078 | 1 MNKP-YSIGLDIGTNSVGWSIITDDYKVPAKKMRVLGNTDKEYIKKNLIGALLFDGGNTA--ADRRLKRTARRRYT | 73 |
| WP_001040080 | 1 MNKP-YSIGLDIGTNSVGWSIITDDYKVPAKKMRVLGNTDKEYIKKNLIGALLFDGGNTA--ADRRLKRTARRRYT | 73 |
| WP_001040081 | 1 MNKP-YSIGLDIGTNSVGWSIITDDYKVPAKKMRVLGNTDKEYIKKNLIGALLFDGGNTA--ADRRLKRTARRRYT | 73 |
| WP_001040083 | 1 MNKP-YSIGLDIGTNSVGWSIITDDYKVPAKKMRVLGNTDKEYIKKNLIGALLFDGGNTA--ADRRLKRTARRRYT | 73 |
| WP_001040085 | 1 MNKP-YSIGLDIGTNSVGWSIITDDYKVPAKKMRVLGNTDKEYIKKNLIGALLFDGGNTA--ADRRLKRTARRRYT | 73 |
| WP_001040087 | 1 MNKP-YSIGLDIGTNSVGWSIITDDYKVPAKKMRVLGNTDKEYIKKNLIGALLFDGGNTA--ADRRLKRTARRRYT | 73 |
| WP_001040088 | 1 MNKP-YSIGLDIGTNSVGWSIITDDYKVPAKKMRVLGNTDKEYIKKNLIGALLFDGGNTA--ADRRLKRTARRRYT | 73 |
| WP_001040089 | 1 MNKP-YSIGLDIGTNSVGWSIITDDYKVPAKKMRVLGNTDKEYIKKNLIGALLFDGGNTA--ADRRLKRTARRRYT | 73 |
| WP_001040090 | 1 MNKP-YSIGLDIGTNSVGWSIITDDYKVPAKKMRVLGNTDKEYIKKNLIGALLFDGGNTA--ADRRLKRTARRRYT | 73 |
| WP_001040091 | 1 MNKP-YSIGLDIGTNSVGWSIITDDYKVPAKKMRVLGNTDKEYIKKNLIGALLFDGGNTA--ADRRLKRTARRRYT | 73 |
| WP_001040092 | 1 MNKP-YSIGLDIGTNSVGWSIITDDYKVPAKKMRVLGNTDKEYIKKNLIGALLFDGGNTA--ADRRLKRTARRRYT | 73 |
| WP_001040094 | 1 MNKP-YSIGLDIGTNSVGWSIITDDYKVPAKKMRVLGNTDKEYIKKNLIGALLFDGGNTA--ADRRLKRTSRRRYT | 73 |
| WP_001040095 | 1 MNKP-YSIGLDIGTNSVGWSIITDDYKVPAKKMRVLGNTDKEYIKKNLIGALLFDGGNTA--ADRRLKRTARRRYT | 73 |
| WP_001040096 | 1 MNKP-YSIGLDIGTNSVGWSIITDDYKVPAKKMRVLGNTDKEYIKKNLIGALLFDGGNTA--ADRRLKRTARRRYT | 73 |
| WP_001040097 | 1 MNKP-YSIGLDIGTNSVGWSIITDDYKVPAKKMRVLGNTDKEYIKKNLIGALLFDGGNTA--ADRRLKRTARRRYT | 73 |
| WP_001040098 | 1 MNKP-YSIGLDIGTNSVGWSIITDDYKVPAKKMRVLGNTDKEYIKKNLIGALLFDGGNTA--ADRRLKRTARRRYT | 73 |
| WP_001040099 | 1 MNKP-YSIGLDIGTNSVGWSIITDDYKVPAKKMRVLGNTDKEYIKKNLIGALLFDGGNTA--ADRRLKRTARRRYT | 73 |
| WP_001040100 | 1 MNKP-YSIGLDIGTNSVGWSIITDDYKVPAKKMRVLGNTDKEYIKKNLIGALLFDGGNTA--ADRRLKRTARRRYT | 73 |
| WP_001040104 | 1 MNKP-YSIGLDIGTNSVGWSIITDDYKVPAKKMRVLGNTDKEYIKKNLIGALLFDGGNTA--ADRRLKRTARRRYT | 73 |
| WP_001040105 | 1 MNKP-YSIGLDIGTNSVGWSIITDDYKVPAKKMRVLGNTDKEYIKKNLIGALLFDGGNTA--ADRRLKRTARRRYT | 73 |
| WP_001040106 | 1 MNKP-YSIGLDIGTNSVGWSIITDDYKVPAKKMRVLGNTDKEYIKKNLIGALLFDGGNTA--ADRRLKRTARRRYT | 73 |
| WP_001040107 | 1 MNKP-YSIGLDIGTNSVGWSIITDDYKVPAKKMRVLGNTDKEYIKKNLIGALLFDGGNTA--ADRRLKRTARRRYT | 73 |
| WP_001040108 | 1 MNKP-YSIGLDIGTNSVGWSIITDDYKVPAKKMRVLGNTDKEYIKKNLIGALLFDGGNTA--ADRRLKRTARRRYT | 73 |
| WP_001040109 | 1 MNKP-YSIGLDIGTNSVGWSIITDDYKVPAKKMRVLGNTDKEYIKKNLIGALLFDGGNTA--ADRRLKRTARRRYT | 73 |
| WP_001040110 | 1 MNKP-YSIGLDIGTNSVGWSIITDDYKVPAKKMRVLGNTDKEYIKKNLIGALLFDGGNTA--ADRRLKRTARRRYT | 73 |
| WP_015058523 | 1 MNKP-YSIGLDIGTNSVGWSIITDDYKVPAKKMRVLGNTDKEYIKKNLIGALLFDGGNTA--SDRRLKRTARRRYT | 73 |
| WP_017643650 | 1 MNKP-YSIGLDIGTNSVGYSVVTDDYKVPAKKMRVLGNTDKEYIKKNLIGALLFDGGNTA--ADRRLKRTARRRYT | 73 |
| WP_017647151 | 1 MNKP-YSIGLDIGTNSVGYSVVTDDYKVPAKKMRVLGNTDKEYIKKNLIGALLFDGGNTA--SDRRLKRTARRRYT | 73 |
| WP_017648376 | 1 MNKP-YSIGLDIGTNSVGWSIITDDYKVPAKKMRVLGNTDKEYIKKNLIGALLFDGGNTA--SDRRLKRTARRRYT | 73 |
| WP_017649527 | 1 MNKP-YSIGLDIGTNSVGYSVVTDDYKVPAKKMRVLGNTDKEYIKKNLIGALLFDGGNTA--ADRRLKRTARRRYT | 73 |
| WP_017771611 | 1 MNKP-YSIGLDIGTNSVGWSIITDDYKVPAKKMRVLGNTDKEYIKKNLIGALLFDGGNTA--ADRRLKRTARRRYT | 73 |
| WP_017771984 | 1 MNKP-YSIGLDIGTNSVGWSIITDDYKVPAKKMRVLGNTDKEYIKKNLIGALLFDGGNTA--ADRRLKRTARRRYT | 73 |

| | | | |
|---|---|---|---|
| CFQ25032 | 1 | MNKP-YSIGLDIGTNSVGWSIITDDYKVPAKKMRVLGNTDKEYIKKNLIGALLFDGGNTA-ADRRLKRTARRRYT | 73 |
| CFV16040 | 1 | MNKP-YSIGLDIGTNSVGWSIITDDYKVPAKKMRVLGNTDKEYIKKNLIGALLFDGGNTA-ADRRLKRTARRRYT | 73 |
| KLJ37842 | 1 | MNKP-YSIGLDIGTNSVGWSIITDDYKVPAKKMRVLGNTDKEYIKKNLIGALLFDGGNTA-ADRRLKRTARRRYT | 73 |
| KLJ72361 | 1 | MNKP-YSIGLDIGTNSVGWSIITDDYKVPAKKMRVLGNTDKEYIKKNLIGALLFDGGNTA-ADRRLKRTARRRYT | 73 |
| KLL20707 | 1 | MNKP-YSIGLDIGTNSVGWSIITDDYKVPAKKMRVLGNTDKEYIKKNLIGALLFDGGNTA-ADRRLKRTARRRYT | 73 |
| KLL42645 | 1 | MNKP-YSIGLDIGTNSVGYSVVTDDYKVPAKKMRVLGNTDKEYIKKNLIGALLFDGGNTA-SDRRLKRTARRRYT | 73 |
| WP_047207273 | 1 | MNKP-YSIGLDIGTNSVGWSIITDDYKVPAKKMRVLGNTDKEYIKKNLIGALLFDGGRNTA-ADRRLKRTARRRYT | 73 |
| WP_047209694 | 1 | MNKP-YSIGLDIGTNSVGWSIITDDYKVPAKKMRVLGNTDKEYIKKNLIGALLFDGGNTA-ADRRLKRTARRRYT | 73 |
| WP_050198062 | 1 | MNKP-YSIGLDIGTNSVGWSIITDDYKVPAKKMRVLGNTDKEYIKKNLIGALLFDGGNTA-ADRRLKRTARRRYT | 73 |
| WP_050201642 | 1 | MNKP-YSIGLDIGTNSVGWSIITDDYKVPAKKMRVLGNTDKEYIKKNLIGALLFDGGNTA-ADRRLKRTARRRYT | 73 |
| WP_050204027 | 1 | MNKP-YSIGLDIGTNSVGWSIITDDYKVPAKKMRVLGNTDKEYIKKNLIGALLFDGGNTA-SDRRLKRTARRRYT | 73 |
| WP_050881965 | 1 | MNKP-YSIGLDIGTNSVGWSIITDDYKVPAKKMRVLGNTDKEYIKKNLIGALLFDGGNTA-ADRRLKRTARRRYT | 73 |
| WP_050886065 | 1 | MNKP-YSIGLDIGTNSVGWSIITDDYKVPAKKMRVLGNTDKEYIKKNLIGALLFDGGNTA-ADRRLKRTARRRYT | 73 |
| AHN30376 | 1 | MNKP-YSIGLDIGTNSVGWSIITDDYKVPAKKMRVLGNTDKEYIKKNLIGALLFDGGNTA-ADRRLKRTARRRYT | 73 |
| EAO78426 | 1 | MNKP-YSIGXDIGTNSVGWSIITDDYKVPAKKMRVLGNTDKEYIKKNLIGALLFDGGNTA-ADRRLKRTARRRYT | 73 |
| CCW42055 | 1 | MNKP-YSIGLDIGTNSVGWSIITDDYKVPAKKMRVLGNTDKEYIKKNLIGALLFDGGNTA-ADRRLKRIARRRYT | 73 |
| WP_003041502 | 1 | MNQK-YSIGLDIGTNSVGWAVITDDYKVPAKKMKVLGNTDKQSIKKNLLGALLFDSGETA-EATRLKRTARRRYT | 73 |
| WP_037593752 | 1 | MKKE-YSIGLDIGTNSVGWAVITDDYKVPAKKMKVLGNTDKQSIKKNLLGALLFDSGETA-EATRLKRTARRRYT | 74 |
| WP_049516684 | 1 | MKKE-YSIGLDIGTNSVGWAVITDDYKVPAKKMKVLGNTDKQSIKKNLLGALLFDSGETA-KATRLKRTARRRYT | 73 |
| GAD46167 | 1 | MKKE-YSIGLDIGTNSVGWAVITDDYKVPAKKMKVLGNTDKQSIKKNLLGALLFDSGETA-EATRLKRTARRRYT | 74 |
| WP_018363470 | 1 | MTKKnYSIGLDIGTNSVGWAVITDDYKVPSKKFKVLGNTNRKSIKKNLMGALLFDSGETA-EATRLKRTARRRYT | 74 |
| WP_003043819 | 1 | MEKK-YSIGLDIGTNSVGWAVITDDYKVPSKKFKVLGNTDRHSIKKNLLGALLFDSGETA-EATRLKRTARRRYT | 73 |
| WP_006269658 | 1 | MGKP-YSIGLDIGTNSVGWAVITDDYKVPAKKMKVLGNTDKQSIKKNLLGALLFDSGETA-EGTRLKRTARRRYT | 73 |
| WP_048800089 | 1 | MTQK-YSIGLDIGTNSVGWAIVITDDYKVPAKKMKILGNTNKQYIKKNLLGALLFDSGETA-KATRLKRTARRRYT | 73 |
| WP_012767106 | 1 | MDKK-YSIGLDIGTNSVGWAVITDDYKVPSKKFKVLGNTDRHSIKKNLLGALLFDSGETA-EATRLKRTARRRYT | 73 |
| WP_014612333 | 1 | MDKK-YSIGLDIGTNSVGWAVITDDYKVPSKKFKVLGNTDRHSIKKNLLGALLFDSGETA-EATRLKRTARRRYT | 73 |
| WP_015017095 | 1 | MDKK-YSIGLDIGTNSVGWAVITDDYKVPSKKFKVLGNTDRHSIKKNLLGALLFDSGETA-EATRLKRTARRRYT | 73 |
| WP_015057649 | 1 | MDKK-YSIGLDIGTNSVGWAVITDDYKVPSKKFKVLGNTDRHSIKKNLLGALLFDSGETA-EATRLKRTARRRYT | 73 |
| WP_048327215 | 1 | MDKK-YSIGLDIGTNSVGWAVITDDYKVPSKKFKVLGNTDRHSIKKNLLGALLFDSGETA-EVTRLKRTTRRRYT | 73 |
| WP_049519324 | 1 | MDKK-YSIGLDIGTNSVGWAVITDDYKVPSKKFKVLGNTDRHSIKKNLLGALLFDSGETA-EATRLKRTARRRYT | 73 |
| WP_012515931 | 1 | MKKP-YTIALDIGTNSVGWVVVVTDDYKVPVPTKKMVLGNTERKTIKKNLIGALLFDSGETA-EGTRLKRTARRRYT | 73 |
| WP_021320964 | 1 | MKKP-YTIALDIGTNSVGWVVVVTDDYRVPTKKKMVLGNTERKTIKKNLIGALLFDSGETA-EGTRLKRTARPRYT | 73 |
| WP_037581760 | 1 | M-EKtYSIGLDIGTNSVGWAVITDDYKVPAKKMKVLGNTDKKYIKKNLIGALLFDSGETA-EATRLKRAARRRYT | 73 |
| WP_004232481 | 1 | MTKKnYSIGLDIGTNSVGWAVITDDYKVPAKKMKVLGNTDKKYIKKNLIGALLFDSGETA-EATRLKRTARRRYT | 74 |
| WP_009854540 | 1 | MTEKnYSIGLDIGTNSVGWAVITDDYKVPAKKMKVLGNTDKKYIKKNLIGALLFDNGETA-EATRLKRTARRRYT | 74 |
| WP_012962174 | 1 | MTKKnYSIGLDIGTNSVGWAVITDDYKVPAKKMKVLGNTDKKYIKKNLIGALLFDSGETA-EATRLKRTARRRYT | 74 |
| WP_039695303 | 1 | M-EKsYSIGLDIGTNSVGFAVITDDYKVPAKKMKVLGNTDKKYIKKNLIGALLFDSGETA-EATRLKRTARRRYT | 73 |
| WP_014334983 | 1 | MRKP-YSIGLDIGTNSVGWAVITDDYKVPSKKMRIQGTTDRTSIKKNLIGALLFDNGETA-EATRLKRTTRRRYT | 73 |
| WP_003099269 | 1 | MRKP-YSIGLDIGTNSVGWAVITDDYKVPSKKMRIQGTTDRTSIKKNLIGALLFDNGETA-EATRLKRTTRRRYT | 73 |
| AHY15608 | 1 | MRKP-YSIGLDIGTNSVGWAVITDDYKVPSKKMRIQGTTDRTSIKKNLIGALLFDNGETA-EATRLKRTTRRRYT | 73 |
| AHY17476 | 1 | ------------------------------------------------------------------------- | |
| ESR09100 | 1 | MRKP-YSIGLDIGTNSVGWAVITDDYKVPSKKMRIQGTTDRTSIKKNLIGALLFDNGETA-EATRLKRTTRRRYT | 73 |
| AGM98575 | 1 | MRKP-YSIGLDIGTNSVGWAVITDDYKVPSKKHIKKNLLGALLFDSGETA-EATRLKRTTRRRYT | 73 |
| ALF27331 | 1 | MKKP-YSIGLDIGTNSVGWAVITDDYKVPSKKHIKKNLLGALLFDSGETA-EATRLKRTTRRRYT | 73 |
| WP_018372492 | 1 | MKKP-YSIGLDIGTNSVGWAVMEDYKVPSKKMKVLGNTDKSHIKKNLLGALLFDSGETAV-ERRLNRTTSRRYD | 74 |
| WP_045618028 | 1 | NNKP-YSIGLDIGTNSVGWAVITDDYKVPSKKMKVLGNTDKQSIKKNLLGALLFDSGETA-ERRLNRTTSRRYD | 73 |
| WP_045635197 | 1 | K-KG-YSIGLDIGTNSVGWAVITDDYKVPSKKMKVLGNTDKHFIKKNLIGALLFDSGETTA-EARRLKRTARRRYT | 74 |
| WP_002263549 | 1 | MKKP-YSIGLDIGTNSVGWAVITDDYKVPSKKMKVLGNTDKRFIKKNLIGALLFDSGETA-EARRLKRTARRRYT | 73 |
| WP_002263887 | 1 | MKKP-YSIGLDIGTNSVGWAVITDDYKVPSKKMKVLGNTDKSHIEKNLLGALLFDSGNTA-EDRRLKRTARRRYT | 73 |
| WP_002264920 | 1 | MKKP-YSIGLDIGTNSVGWAVITDDYKVPSKKMKVLGNTDKSHIKKNLLGALLFDSGNTA-EDRRLKRTARRRYT | 73 |
| WP_002269043 | 1 | MKKP-YSIGLDIGTNSVGWAVITDDYKVPSKKMKVLGNTDKSHIKKNLLGALLFDSGNTA-EDRRLKRTARRRYT | 73 |
| WP_002269448 | 1 | MKKP-YSIGLDIGTNSVGWAVITDDYKVPAKKMKVLGNTDKSHIKKNLLGALLFDSGNTA-EDRRLKRTARRRYT | 73 |
| WP_002271977 | 1 | MKKP-YSIGLDIGTNSVGWAVVTDDYKVPAKKMKVLGNTDKSHIKKNLLGALLFDSGNTA-EDRRLKRTARRRYT | 73 |

| ID | 1 | Sequence | End |
|---|---|---|---|
| WP_002272766 | 1 | MKKP-YSIGLDIGTNSVGWAVTDDYKVPAKKMKVLGNTDKSHIKKNLLGALLFDSGNTA--EDRRLKRTARRRYT | 73 |
| WP_002273241 | 1 | MKKP-YSIGLDIGTNSVGWAVTDDYKVPAKKMKVLGNTDKSHIKKNLLGALLFDSGNTA--EDRRLKRTARRRYT | 73 |
| WP_002275430 | 1 | MKKP-YSIGLDIGTNSVGWAVTDDYKVPAKKMKVLGNTDKSHIKKNLLGALLFDSGNTA--ADRRLKRTARRRYT | 73 |
| WP_002276448 | 1 | MKKP-YSIGLDIGTNSVGWAVTDDYKVPAKKMKVLGNTDKSHIKKNLLGALLFDSGNTA--EDRRLKRTARRRYT | 73 |
| WP_002277050 | 1 | MKKS-YSIGLDIGTNSVGWAVTDDYKVPAKKMKVLGNTDKSHIKKNLLGALLFDSGNTA--EDRRLKRTARRRYT | 73 |
| WP_002773364 | 1 | MKKS-YSIGLDIGTNSVGWAVTDDYKVPAKKMKVLGNTDKSHIKKNLLGALLFDSGNTA--EDRRLKRTARRRYT | 73 |
| WP_002279025 | 1 | MKKP-YSIGLDIGTNSVGWAVTDDYKVPAKKMKVLGNTDKSHIKKNLLGALLFDSGNTA--EDRRLKRTARRRYT | 73 |
| WP_002279859 | 1 | MKKP-YSIGLDIGTNSVGWAVTDDYKVPAKKMKVLGNTDKSHIKKNLLGALLFDSGNTA--EDRRLKRTARRRYT | 73 |
| WP_002280230 | 1 | MKKP-YSIGLDIGTNSVGWAVTDDYKVPAKKMKVLGNTDKSHIKKNLLGALLFDSGNTA--ADRRLKRTARRRYT | 73 |
| WP_002281696 | 1 | MKKP-YSIGLDIGTNSVGWAVTDDYKVPAKKMKVLGNTDKSHIKKNLLGALLFDSGNTA--EDRRLKRTARRRYT | 73 |
| WP_002282247 | 1 | MKKP-YSIGLDIGTNSVGWAVTDDYKVPAKKMKVLGNTDKSHIKKNLLGALLFDSGNTA--ADRRLKRTARRRYT | 73 |
| WP_002282906 | 1 | MKKP-YSIGLDIGTNSVGWSVVTDDYKVPAKKMKVLGNTDKSHIEKNLLGALLFDSGNTA--EDRRLKRTARRRYT | 73 |
| WP_002283846 | 1 | MKKP-YSIGLDIGTNSVGWAVTDDYKVSAKKMKVLGNTDKSHIKKNLLGALLFDSGNTA--EDRRLKRTARRRYT | 73 |
| WP_002287255 | 1 | MKKP-YSIGLDIGTNSVGWAVTDDYKVPAKKMKVLGNTDKSHIKKNLLGALLFDSGNTA--EDRRLKRTARRRYT | 73 |
| WP_002288990 | 1 | MKKP-YSIGLDIGTNSVGWAVTDDYKVPAKKMKVLGNTDKSHIKKNLLGALLFDSGNTA--EDRRLKRTARRRYT | 73 |
| WP_002289641 | 1 | MKKP-YSIGLDIGTNSVGWAVTDDYKVPAKKMKVLGNTDKSHIKKNLLGALLFDSGNTA--EDRRLKRTTRRRYT | 73 |
| WP_002290427 | 1 | MKKP-YSIGLDIGTNSVGWAVTDDYKVPAKKMKVLGNTDKSHIKKNLLGALLFDSGNTA--ADRRLKRTARRRYT | 73 |
| WP_002295753 | 1 | MKKP-YSIGLDIGTNSVGWAVTDDYKVPAKKMKVLGNTDKSHIKKNLLGALLFDSGNTA--EDRRLKRTARRRYT | 73 |
| WP_002296423 | 1 | MKKP-YSIGLDIGTNSVGWAVTDDYKVPAKKMKVLGNTDKSHIKKNLLGALLFDSGNTA--EDRRLKRTARRRYT | 73 |
| WP_002304487 | 1 | MKKP-YSIGLDIGTNSVGWAVTDDYKVPAKKMKVLGNTDKSHIKKNLLGALLFDSGNTA--EDRRLKRTARRRYT | 73 |
| WP_002305844 | 1 | MKKP-YSIGLDIGTNSVGWAVTDDYKVPAKKMKVLGNTDKSHIKKNLLGALLFDSGNTA--EDRRLKRTARRRYT | 73 |
| WP_002307203 | 1 | MKKP-YSIGLDIGTNSVGWAVTDDYKVPAKKMKVLGNTDKSHIKKNLLGALLFDSGNTA--EDRRLKRTARRRYT | 73 |
| WP_002310390 | 1 | MKKP-YSIGLDIGTNSVGWAVTDDYKVPAKKMKVLGNTDKSHIKKNLLGALLFDSGNTA--EDRRLKRTARRRYT | 73 |
| WP_002352408 | 1 | MKKP-YSIGLDIGTNSVGWAVTDDYKVPAKKMKVLGNTDKSHIKKNLLGALLFDSGNTA--EDRRLKRTARRRYT | 73 |
| WP_012997688 | 1 | MKKP-YSIGLDIGTNSVGWAVTDDYKVPAKKMKVLGNTDKSHIKKNLLGALLFDSGNTA--ADRRLKRTARRRYT | 73 |
| WP_014677909 | 1 | MKKP-YSIGLDIGTNSVGWAVTDDYKVPDKKMKVLGNTDKSHIKKNLLGALLFDSGNTA--EDRRLKRTARRRYT | 73 |
| WP_019312892 | 1 | MKKP-YSIGLDIGTNSVGWAVTDDYKVPAKKMKVLGNTDKSHIKKNLLGALLFDSGNTA--EDRRLKRTARRRYT | 73 |
| WP_019313659 | 1 | MKKP-YSIGLDIGTNSVGWAVTDDYKVPAKKMKVLGNTDKSHIEKNLLGALLFDSGNTA--EDRRLKRTARRRYT | 73 |
| WP_019314093 | 1 | MKKP-YSIGLDIGTNSVGWAVTDDYKVPAKKMKVLGNTDKSHIKKNLLGALLFDSGNTA--ADRRLKRTARRRYT | 73 |
| WP_019315370 | 1 | MKKP-YSIGLDIGTNSVGWAVTDDYKVPAKKMKVLGNTDKSHIKKNLLGALLFDSGNTA--EDRRLKRTARRRYT | 73 |
| WP_019803776 | 1 | MKKP-YSIGLDIGTNSVGWAVTDDYKVPAKKMKVLGNTDKSHIKKNLLGALLFDSGNTA--EDRRLKRTARRRYT | 73 |
| WP_019805234 | 1 | MKKP-YSIGLDIGTNSVGWAVTDDYKVPAKKMKVLGNTDKSHIKKNLLGALLFDSGNTA--EDRRLKRTARRRYT | 73 |
| WP_024783594 | 1 | MKKP-YSIGLDIGTNSVGWAVTDDYKVPAKKMKVLGNTDKSHIKKNLLGALLFDSGNTA--EDRRLKRTARRRYT | 73 |
| WP_024784288 | 1 | MKKP-YSIGLDIGTNSVGWAVTDDYKVPAKKMKVLGNTDKSHIKKNLLGALLFDSGNTA--ADRRLKRTARRRYT | 73 |
| WP_024784666 | 1 | MKKP-YSIGLDIGTNSVGWAVTDDYKVPAKKMKVLGNTDKSHIKKNLLGALLFDSGNTA--EDRRLKRTARRRYT | 73 |
| WP_024784894 | 1 | MKKP-YSIGLDIGTNSVGWAVTDDYKVPAKKMKVLGNTDKSHIKKNLLGALLFDSGNTA--EDRRLKRTARRRYT | 73 |
| WP_024786433 | 1 | MKKP-YSIGLDIGTNSVGWAVTDDYKVPAKKMKVLGNTDKSHIKKNLLGALLFDSGNTA--ADRRLKRTARRRYT | 73 |
| WP_049473442 | 1 | MKKP-YSIGLDIGTNSVGWAVTDDYKVPAKKMKVLGNTDKSHIKKNLLGALLFDSGNTA--EDRRLKRTTRRRYT | 73 |
| WP_049474547 | 1 | MKKP-YSIGLDIGTNSVGWAVTDDYKVPAKKMKVLGNTDKSHIKKNLLGALLFDSGNTA--ADRRLKRTARRRYT | 73 |
| EMC03581 | 1 | MDL------IGTNSVGWAVTDDYKVPAKKMKVLGNTDKSHIKKNLLGALLFDSGNTA--EDRRLKRTARRRYT | 66 |
| WP_000428612 | 1 | ENKN-YSIGLDIGTNSVGWAVITDDYKVPSKKMKVLGNTDKRFIKKNLIGALLFDEGTTA--EARRLKRTARRRYT | 74 |
| WP_000428613 | 1 | ENKN-YSIGLDIGTNSVGWAVITDDYKVPSKKMKVLGNTDKRFIKKNLIGALLFDEGTTA--ADRRLKRTARRRYT | 74 |
| WP_049523028 | 1 | K-KP-YSIGLDIGTNSVGWAVITDDYKVPAKKMKVLGNTNKESIKKNLIGALLFDAGNTA--ADRRLKRTARRRYT | 73 |
| WP_003107102 | 1 | ------MKVLGNTDRQTVKKQNMIGTLLFDSGETA--EARRLKRTARRRYT | 42 |
| WP_054279288 | 1 | -KKS-YSIGLDIGTNSVGWAVITDDYKVPAKKMKVLGNTSRQSIKQNMIGALLFDEGPA--ASTVKRTTRRRYT | 75 |
| WP_049531101 | 1 | SNKP-YSIGLDIGTNSVGWVIITDDYKVPAKKMKVLGNTDKHFIKKNLIGALLFDEGTTA--EDRRLKRTARRRYT | 74 |
| WP_049538452 | 1 | SNKP-YSIGLDIGTNSVGWVIITDDYKVPSKKMKVLGNTDKHFIKKNLIGALLFDEGTTA--EDRRLKRTARRRYT | 74 |
| WP_049549711 | 1 | --YS-YSIGLDIGTNSVGWAVINEDYKVPAKKMTVFGNTDRKTIKKNLLGTVLFDSGETA--QARRLKRTNRRRYT | 75 |
| WP_007896501 | 1 | -------MLGTVLFDSGETA--QARRLKRTNRRRYT | 27 |
| EFR44625 | 1 | K-KP-YSIGLDIGTNSVGWSVITDDYKVPSKKMKVLGNTDKHFIKKNLIGALLFDEGTTA--ESRRLKRTARRRYT | 73 |
| WP_002897477 | 1 | K-KP-YSIGLDIGTNSVGWAVITDDYKVPSKKMKVLGNTDKHFIKKNLIGALLFDEGTTA--EDRRLKRTSRRRYT | 73 |
| WP_002906454 | 1 | ENKN-YSIGLDIGTNSVGWSVITDDYKVPSKKMKVLGNTDKHFIKKNLIGALLFDEGTTA--EARRLKRTARRRYT | 74 |
| WP_009729476 | 1 | ENKN-YSIGLDIGTNSVGWSVITDDYKVPSKKMKVLGNTDKHFIKKNLIGALLFDEGTTA--EARRLKRTARRRYT | 74 |

```
                -continued

CQR24647      1  MKKP-YSIGLDIGTNSVGWAVITDDYKVPAKKMKVLGNTDKEYIKKNLIGALLFDSGETA-EATMKRTARRRYT  73
WP_000066813  1  SNKS-YSIGLDIGTNSVGWAVITDDYKVPSKKMKVLGNTDKHFIKKNLIGALLFDEGTTA-EDRRLKRTARRRYT  74
WP_009754323  1  NNNN-YSIGLDIGTNSVGWAVITDDYKVPSKKMRVLGNTDKRFIKKNLIGALLFDEGTTA-EDRRLKRTARRRYT  74
WP_044674937  1  MKKK-YAIGIDIGTNSVGWAVITDDYKVPSKKMKVFGNTEKRYIKKNLLGTLLFDEGNTA-ENRRLKRTARRRYT  73
WP_044676715  1  MKKK-YAIGIDIGTNSVGWAVITDDYKVPSKKMKVFGNTEKRYIKKNLLGTLLFDEGNTA-ENRRLKRTARRRYT  73
WP_044680361  1  MKKK-YAIGIDIGTNSVGWAVITDDYKVPSKKMKVFGNTEKRYIKKNLLGTLLFDEGNTA-ENRRLKRTARRRYT  73
WP_044681799  1  MKKK-YAIGIDIGTNSVGWSVVITDDYKVPSKKMKVFGNTEKRYIKKNLLGTLLFDEGNTA-ENRRLKRTARRRYT  73
WP_049533112  1  MDQK-YSIGLDIGTNSVGWAVVITDDYKVPAKKMKVLGNTDKQSIKKNLLGALLFDSGETA-EATLKRTARRRYT  73
WP_029090905  1  ----------------------------------------MWGVSLFEAGKTA-AERRGYRSTRRRLN  27
WP_065506696  1  I-VD-YCIGLDLGTGSVGWAVVDMNHRLMKRN--------GKHLWGSRLFSNAFTA-ANRRASRSIRRRYN  60
AIT42264      1  MDKK-YSIGLDIGTNSVGWAVITDEYKVPSKKPKVLGNTDRHSIKKNLIGALLFDSGETA-EATLKRTARRRYT  73
WP_034440723  1  -MKN-YTIGLDIGTNSVGWAVIKDDLTLVRKKISGNTDKKFKVLGNTDKKFKKNLIGALLFDEGGTA-QDTRVKRIARRRYE  72
AKQ21048      1  MDKK-YSIGLDIGTNSVGWAVITDEYKVPSKKFKVLGNTDRHSIKKNLIGALLFDEGHTA-EATLKRTARRRYT  73
WP_004636532  1  MQKN-YTIGLDIGTNSVGWAVMKDDYTLLRKRMKVLGNTDIKKIKKNFWGVRLFDEGHTA-KETRLKRGTRRRYQ  73
WP_002364836  1  MKKD-YVIGLDIGTNSVGWAVMTEDYQLVKKMPIYGNTEKKRIKKNFWGVRLFEEGHTA-EDRRLKRTARRRIS  73
WP_016631044  1  -----------------------MRLFEEGHTA-EDRRLKRTARRRIS  24
EMS75795      1  MKKD-YVIGLDIGTNSVGWAVMTEDYQLVKKMPIYGNTEKKKIKKNFWGVRLFEEGHTA-EDRRLKRTARRRIS  73
WP_002373311  1  MKKD-YVIGLDIGTNSVGWAVMTEDYQLVKKMPIYGNTEKKKIKKNFWGVRLFEEGHTA-EDRRLKRTARRRIS  73
WP_002378009  1  MKKD-YVIGLDIGTNSVGWAVMTEDYQLVKKMPIYGNTEKKKIKKNFWGVRLFEEGHTA-EDRRLKRTARRRIS  73
WP_002407324  1  MKKD-YVIGLDIGTNSVGWAVMTEDYQLVKKMPIYGNTEKKKIKKNFWGVRLFEEGHTA-EDRRLKRTARRRIS  73
WP_002413717  1  MKKD-YVIGLDIGTNSVGWAVMTEDYQLVKKMPIYGNTEKKKIKKNFWGVRLFEEGHTA-EDRRLKRTARRRIS  73
WP_010775580  1  MKKD-YVIGLDIGTNSVGWAVMTEDYQLVKKMPIYGNTEKKKIKKNFWGVRLFEEGHTA-EDRRLKRTARRRIS  73
WP_010818269  1  MKKD-YVIGLDIGTNSVGWAVMTEDYQLVKKMPIYGNTEKKKIKKNFWGVRLFEEGHTA-EDRRLKRTARRRIS  73
WP_010824395  1  MKKD-YVIGLDSNSVGWAVMTEDYQLVKKMPIYGNTEKKKIKKNFWGVRLFEEGHTA-EDRRLKRTARRRIS  73
WP_016622645  1  MKKD-YVIGLDIGTNSVGWAVMTEDYQLVKKMPIYGNTEKKKIKKNFWGVRLFEEGHTA-EDRRLKRTARRRIS  73
WP_033624816  1  MKKD-YVIGLDIGTNSVGWAVMTEDYQLVKKMPIYGNTEKKKIKKNFWGVRLFEEGHTA-EDRRLKRTARRRIS  73
WP_002625576  1  MKKD-YVIGLDIGTNSVGWAVMTEDYQLVKKMPIYGNTEKKKIKKNFWGVRLFEEGHTA-EDRRLKRTARRRIS  73
WP_033789179  1  MKKD-YVIGLDIGTNSVGWAVMTEDYQLVKKMPIYGNTEKKKIKKNFWGVRLFEEGHTA-EDRRLKRTARRRIS  73
WP_002310644  1  MKKE-YTIGLDIGTNSVGWSVLTDDYRLVSKKMKVAGNTEKSSTKKNFWGVRLFDEQGTA-EARRSKRTARRRLA  73
WP_002312694  1  MKKE-YTIGLDIGTNSVGWSVLTDDYRLVSKKMKVAGNTEKSSTKKNFWGVRLFDEQGTA-EARRSKRTARRRLA  73
WP_002314015  1  MKKE-YTIGLDIGTNSVGWSVLTDDYRLVSKKMKVAGNTEKSSTKKNFWGVRLFDEQGTA-EARRSKRTARRRLA  73
WP_002320716  1  MKKE-YTIGLDIGTNSVGWSVLTDDYRLVSKKMKVAGNTEKSSTKKNFWGVRLFDEQGTA-EARRSKRTARRRLA  73
WP_002330729  1  MKKE-YTIGLDIGTNSVGWSVLTDDYRLVSKKMKVAGNTEKSSTKKNFWGVRLFDEQGTA-EARRSKRTARRRLA  73
WP_002335161  1  MKKE-YTIGLDIGTNSVGWSVLTDDYRLVSKKMKVAGNTEKSSTKKNFWGVRLFDEQGTA-EARRSKRTARRRLA  73
WP_002345439  1  MKKE-YTIGLDIGTNSVGWSVLTDDYQLMKRMSVHGNTEKKKIKKNFWGVRLFDEQGTA-EFRRTKRTNRRRLA  73
WP_034867970  1  MTKD-YTIGLDIGTNSVGWSVLTDDYQLMKRMSVHGNTEKKKIKKNFWGVRLFDEQGTA-EFRRTKRTNRRRLA  73
WP_047937432  1  MKKE-YTIGLDIGTNSVGWSVLTDDYRLVSKKMKVAGNTEKSSTKKNFWGVRLFDEQGTA-EARRSKRTARRRLA  73
WP_010720994  1  MTKD-YTIGLDIGTNSVGWAVLTDDYQLMKRMSVHGNTEKKKIKKNFWGARLFDEQGTA-EFRRTKRTNRRRLA  73
WP_010073004  1  MTKD-YTIGLDIGTNSVGWAVLTDDYQLMKRMSVHGNTEKKKIKKNFWGARLFDEQGTA-EFRRTKRTNRRRLA  73
WP_034700478  1  MTKD-YTIGLDIGTNSVGWAVLTDDYQLMKRMSVHGNTEKKKIKKNFWGARLFDEQGTA-EFRRTKRTNRRRLA  73
WP_072009003  1  MKND-YTIGLDIGTNSVGYSVVTDDYKVISKKNNVFGNTEKKSIKKNFWGARLFESGGTA-QEARMKRTSRRRIA  73
WP_023519017  1  MEKE-YTIGLDIGTNSVGWAVLTDDYRLVARKMSIQGDSNRKKIKKNFWGARLFEEGKTA-QFRRIKRTNRRRIA  73
WP_010770040  1  MGKE-YTIGLDIGTNSVGWAVLTENYDLVKKMKVYGNTETKYLKKNLWGTRLFDEGMTA-ADRRLKRTTRRRYS  73
WP_048640708  1  MGKE-YTIGLDIGTNSVGWAVLQEDLDIVRRKMKVYGNTEKNVLKKNFWGVLLFNEGQTA-KDTRLKRTTRRRYF  73
WP_010750235  1  MNKA-YTLGLDIGTNSVGWAVLTDDYRLMAKKMPVHSKMEKKKIKKNFWGARLFDEQGTA-EERRNKRATRRRLR  73
AII16583      1  ADKK-YSIGLDIGTNSVGWSVITDDYKVPSKKFKVLGNTDRHSIKKNLIGALLFDSGETA-EATRLKRTARRRIE  112
WP_029073316  1  NNKI-YNIGLDIGDASVGWAVVDEHYNLLKRH---------GKHMWGSRLFTQANTA-VERSSSRTRRRYN  65
WP_031589969  1  NNNI-YSIGLDIGDASVGWAVVDEHYNLLKRH---------GKHMWGSRLFTQANTA-VERRSSRSTRRRYN  65
KDA45870      1  LKKD-YSIGLDIGTNSVGHAVVTDDYKVPTKMKVFGDTSKKTIKKNMLGVLLFNEGQTA-ADTRLKRGARRRYT  74
WP_039099354  1  MSRP-YNIGLDIGTSSIGWSVVDDQSKLVSVR---------GKYGYGVRLYDEGQTA-AERRSFRTTRRRLK  61
AKP02966      1  KEQP-YNIGLDIGTGSVGWAVTNDNYDLLNIK---------KKNLWGVRLFEGAQTA-KETRLNRSTRRRYR  64
WP_010991369  1  MKKP-YTIGLDIGTNSVGWAVLTDQYDIVKRKMKIAGDSEKKQIKKNFWGVRLFDEGQTA-ADRRMARTARRRIE  73
WP_033838504  1  MKKP-YTIGLDIGTNSVGWAVLTDQYDLVKRKMKIAGDSEKKQIKKNFWGVRLFDEGQTA-ADRRMARTARRRIE  73
```

```
EHN60060           1 MKKP-YTIGLDIGTNSVGWAVLTDQYDLVKRKMKIAGDSEKKQIKKQNFWGVRLFDEQTA--ADRRMARTARRRIE    76
EFR89594           1 MRKP-YTIGLDIGTNSVGWAVLTDQYNLVKRKMKVAGSAEKKQIKKQNFWGVRLFDEGEVA--AGRRMNRTTRRRIE    73
WP_038409211       1 ----------------------------------------------------------------------------
EFR95520           1 ----------------------------------------------------------------------------
WP_003723650       1 MKNP-YTIGLDIGTNSVGWAVLTDQYDLVKRKMKVAGNSDKKQIKKQNFWGVRLFDDQTA--VDRRMNRTARRRIE    73
WP_003727705       1 MKNP-YTIGLDIGTNSVGWAVLTDQYDLVKRKMKVAGNSDKKQIKKQNFWGVRLFDDGQTA--VDRRMNRTARRRIE    73
WP_003730785       1 MKNP-YTIGLDIGTNSVGWAVLTDQYDLVKRKMKVAGNSDKKQIKKQNFWGVRLFDDGQTA--VDRRMNRTARRRIE    73
WP_003733029       1 MKNP-YTIGLDIGTNSVGWAVLTDQYDLVKRKMKVAGNSDKKQIKKQNFWGVRLFDDGQTA--AKRRMSRTARRRIE    73
WP_003739838       1 MKNP-YTIGLDIGTNSVGWAVLTDQYDLVKRKMKISGDSEKKQIKKQNFWGVRLFEKGETA--ADRRMNRTARRRIE    73
WP_014601172       1 MKNP-YTIGLDIGTNSVGWAVLTDQYDLVKRKMKVAGNSDKKQIKKQNFWGVRLFDDGQTA--VDRRMNRTARRRIE    73
WP_023548323       1 MKNP-YTIGLDIGTNSVGWAVLTDQYDLVKRKMKVAGNSDKKQIKKQNFWGVRLFDDGQTA--VDRRMNRTARRRIE    73
WP_031665337       1 MKNP-YTIGLDIGTNSVGWAVLTDQYDLVKRKMKVAGNSDKKQIKKQNFWGVRLFDDGQTA--VDRRMNRTARRRIE    73
WP_031669209       1 MKNP-YTIGLDIGTNSVGWAVLTDQYDLVKRKMKISGDSEKKQIKKQNFWGVRLFEKGETA--AKRRMSRTARRRIE    73
WP_033920898       1 MKKP-YTIGLDIGTNSVGWAVLTDQYDLVKRKMKVAGNSDKKQIKKQNFWGVRLFDDGQTA--VDRRMNRTARRRIE    73
AKI42028           1 MKNP-YTIGLDIGTNSVGWAVLTNQYDLVKRKMKVAGNSDKKQIKKQNFWGVRLFDDGQTA--VDRRMNRTARRRIE    76
AKI50529           1 MKNP-YTIGLDIGTNSVGWAVLTNQYDLVKRKMKVAGNSDKKQIKKQNFWGVRLFDDGQTA--VDRRMNRTARRRIE    76
EFR83390           1 ----------------------------------------------------------------------------
WP_046323366       1 MKKP-YTIGLDIGTNSVGWAALTDQYDLVKRENVAGSEKKQIKKNLWGVRLVDEGKTA--AHRRVNRTTRRRIE    73
AKE81011           1 ADKK-YSIGLDIGTNSVGWAVITDEYKVPSKKFPKVLGNTDRHSIKKNLIGALLFDSGETA--EATRLKRTARRRYT    89
CUO82355           1 I-VD-YCIGLDLGTGSVGWAVVDMNHRLMKRN-----------------GKHLWGSRLFSNAETA--ATRRSRSIRRRYN    64
WP_033162887       1 KDIR-YSIGLDIGTNSVGWAVMDEHYELLKKG-----------------NHHMWGSRLFDAAEPA--ATRRASRSIRRRYN    65
AGZ01981           1 ADKK-YSIGLDIGTNSVGWAVITDEYKVPSKKFKVLGNTDRHSIKKNLIGALLFDSGETA--EATRLKRTARRRYT   106
AKA60242           1 MDKK-YSIGLDIGTNSVGWAVITDEYKVPSKKFKVLGNTDRHSIKKNLIGALLFDSGETA--EATRLKRTARRRYT    73
AKS40380           1 MDKK-YSIGLDIGTNSVGWAVITDEYKVPSKKFKVLGNTDRHSIKKNLIGALLFDSGETA--EATRLKRTARRRYT    73
4UN5_B             1 MDKK-YSIGLAIGTNSVGWAVITDEYKVPSKKFPKVLGNTDRHSIKKNLIGALLFDSGETA--EATRLKRTARRRYT    77
WP_010922251      74 RRKQNRICYLQEIFSNEMAKVDDSFFHRLEE-SFLV--EEDKK---H ERHPIFGN[V-DEVAYHEKYPTI]LRKKLV   143
WP_039695303      75 RRKQNRLRYLQEIFANEIAKVDESFFQRLDE-SFLT--DDDKT---F DSHPIFGNKA-EEDAYHQKFPTIYHLRKHLA   144
WP_045635197      74 RRKQNRLRYLQEIFSEEMSKVDSSFFHRLDD-SFLI--PEDKR---E SKYPIFATLT-EEKEYHKQFPTIYHLRKQLA   143
5AXW_A            62 RRRHRIQRVKKLLFD------YNLLTDhSELS----------G ---NPYEARVK----------GLSQKLS   104
WP_009880683       1 ----------------------------------------------------------------------------
WP_010922251      74 RRKQNRICYLQEIFSNEMAKVDDSFFHRLEE-SFLV--EEDKK---H ERHPIFGNIV-DEVAYHEKYPTIYHLRKKLV   143
WP_011054416      74 RRKQNRICYLQEIFSNEMAKVDDSFFHRLEE-SFLV--EEDKK---H ERHPIFGNIV-DEVAYHEKYPTIYHLRKKLA   143
WP_011284745      74 RRKQNRICYLQEIFSNEMAKVDDSFFHRLEE-SFLV--EEDKK---H ERHPIFGNIV-DEVAYHEKYPTIYHLRKKLV   143
WP_011285506      74 RRKQNRICYLQEIFSNEMAKVDDSFFHRLEE-SFLV--EEDKK---H ERHPIFGNIV-DEVAYHEKYPTIYHLRKKLV   143
WP_011527619      74 RRKQNRICYLQEIFSNEMAKVDDSFFHRLEE-SFLV--EEDKK---H ERHPIFGNIV-DEVAYHEKYPTIYHLRKKLV   143
WP_012560673      74 RRKQNRICYLQEIFSNEIAKVDDSFFHRLEE-SFLV--EEDKK---H ERHPIFGNIV-DEVAYHEKYPTIYHLRKKLV   143
WP_014407541      74 RRKQNRICYLQEIFSNEMAKVDDSFFHRLEE-SFLV--EEDKK---H ERHPIFGNIV-DEVAYHEKYPTIYHLRKKLA   143
WP_020905136      74 RRKQNRICYLQEIFSNEMAKVDDSFFHRLEE-SFLV--EEDKK---H ERHPIFGNIV-DEVAYHEKYPTIYHLRKKLA   143
WP_023080005      74 RRKQNRICYLQEIFSNEMAKVDDSFFHRLEE-SFLV--EEDKK---H ERHPIFGNIV-DEVAYHEKYPTIYHLRKKLA   143
WP_023610282      74 RRKQNRICYLQEIFSNEMAKVDDSFFHRLEE-SFLV--EEDKK---H ERHPIFGNIV-DEVAYHEKYPTIYHLRKKLV   143
WP_030125963      74 RRKQNRICYLQEIFSNEMAKVDDSFFHRLEE-SFLV--EEDKK---H ERHPIFGNIV-DEVAYHEKYPTIYHLRKKLV   143
WP_030126706      74 RRKQNRICYLQEIFSNEMAKVDDSFFHRLEE-SFLV--EEDKK---H ERHPIFGNIV-DEVAYHEKYPTIYHLRKKLA   143
WP_031488318      74 RRKQNRICYLQEIFSNEMAKVDDSFFHRLEE-SFLV--EEDKK---H ERHPIFGNIV-DEVAYHEKYPTIYHLRKKLA   143
WP_032460140      74 RRKQNRICYLQEIFSNEIAKVDDSFFHRLEE-SFLV--EEDKK---H ERHPIFGNIV-DEVAYHEKYPTIYHLRKKLA   143
WP_032461047      74 RRKQNRICYLQEIFSNEMAKVDDSFFHRLEE-SFLV--EEDKK---H ERHPIFGNIV-DEVAYHEKYPTIYHLRKKLA   143
WP_032462016      74 RRKQNRICYLQEIFSNEMAKVDDSFFHRLEE-SFLV--EEDKK---H ERHPIFGNIV-DEVAYHEKYPTIYHLRKKLA   143
WP_032462936      74 RRKQNRICYLQEIFSNEMAKVDDSFFHRLEE-SFLV--EEDKK---H ERHPIFGNIV-DEVAYHEKYPTIYHLRKKLA   143
WP_032464890      74 RRKQNRICYLQEIFSNEMAKVDDSFFHRLEE-SFLV--EEDKK---H ERHPIFGNIV-DEVAYHEKYPTIYHLRKKLV   143
WP_033888930       1 ----------------------------------------------------------------------------
WP_038431314      74 RRKQNRICYLQEIFSNEMAKVDDSFFHRLEE-SFLV--EEDKK---H ERHPIFGNIV-DEVAYHEKYPTIYHLRKKLA   143
WP_038432938      74 RRKQNRICYLQEIFSNEMAKVDDSFFHRLEE-SFLV--EEDKK---H ERHPIFGNIV-DEVAYHEKYPTIYHLRKKLA   143
WP_038434062      74 RRKQNRICYLQEIFSNEMAKVDDSFFHRLEE-SFLV--EEDKK---H ERHPIFGNIV-DEVAYHEKYPTIYHLRKKLV   143
BAQ51233           1 ----------------MAKVDDSFFHRLEE-SFLV--EEDKK---H ERHPIFGNIV-DEVAYHEKYPTIYHLRKKLA    54
```

-continued

| | | | | |
|---|---|---|---|---|
| KGE60162 | | | | |
| KGE60856 | | | | |
| WP_002989955 | RRRNRICYLQEIFSNEMAKVDDSFFHRLEE-SFLV--EEDKK---H | ERHPIFGNIV-DEVAYHEKPTIYHLRKKLV | | 143 |
| WP_003030002 | RRRNRLRYLQEIFAEEMNKVDDENFFQRLDD-SFLV--DEDKR--- | ERHPIFGNIA-AEVKYHDDFPTIYHLRKHLA | | 143 |
| WP_003065552 | RRRNRLRYLQEIFAEEMTKVDDESFFQRLDE-SFLRwGDDNKK--L | GRYPIFGNKA-DVVKYHQEFPTIYHLRKHLA | | 146 |
| WP_001040076 | RRRNRIRILYLQEIFAEEMSKVDDSFFHRLED-SFLV--EEDKR---G | SKYPIFATLQ-EEKYYHEKPTIYHLRKELA | | 143 |
| WP_001040078 | RRRNRIRILYLQEIFAEEMSKVDDSFFHRLED-SFLV--EEDKR---G | SKYPIFATLQ-EEKDYHEKPTIYHLRKELA | | 143 |
| WP_001040080 | RRRNRIRILYLQEIFAEEMSKVDDSFFHRLED-SFLV--EEDKR---G | SKYPIFATLQ-EEKDYHEKFSTIYHLRKELA | | 143 |
| WP_001040081 | RRRNRIRILYLQEIFAEEMSKVDDSFFHRLED-SFLV--EEDKR---G | SKYPIFATLQ-EEKDYHEKFPTIYHLRKELA | | 143 |
| WP_001040083 | RRRNRIRILYLQEIFAEEMSKVDDSFFHRLED-SFLV--EEDKR---G | SKYPIFATLQ-EEKDYHEKFSTIYHLRKELA | | 143 |
| WP_001040085 | RRRNRIRILYLQEIFAEEMSKVDDSFFHRLED-SFLV--EEDKR---G | SKYPIFATLQ-EEKDYHEKFSTIYHLRKELA | | 143 |
| WP_001040087 | RRRNRIRILYLQEIFAEEMSKVDDSFFHRLED-SFLV--EEDKR---G | SKYPIFATLQ-EEKDYHEKFSTIYHLRKELA | | 143 |
| WP_001040088 | RRRNRIRILYLQEIFAEEMSKVDDSFFHRLED-SFLV--EEDKR---G | SKYPIFATLQ-EEKDYHEKFSTIYHLRKELA | | 143 |
| WP_001040089 | RRRNRIRILYLQEIFAEEMSKVDDSFFHRLED-SFLV--EEDKR---G | SKYPIFATLQ-EEKYYHEKPTIYHLRKELA | | 143 |
| WP_001040090 | RRRNRIRILYLQEIFAEEMSKVDDSFFHRLED-SFLV--EEDKR---G | SKYPIFATLQ-EEKYYHEKPTIYHLRKELA | | 143 |
| WP_001040091 | RRRNRIRILYLQEIFAEEMSKVDDSFFHRLED-SFLV--EEDKR---G | SKYPIFATLQ-EEKDYHEKFSTIYHLRKELA | | 143 |
| WP_001040092 | RRRNRIRILYLQEIFAEEMSKVDDSFFHRLED-SFLV--EEDKR---G | SKYPIFATLQ-EEKDYHEKFSTIYHLRKELA | | 143 |
| WP_001040094 | RRRNRIRILYLQEIFAEEMSKVDDSFFHRLED-SFLV--EEDKR---G | SKYPIFATMQ-EEKYYHEKPTIYHLRKELA | | 143 |
| WP_001040095 | RRRNRIRILYLQEIFAEEMSKVDDSFFHRLED-SFLV--EEDKR---G | SKYPIFATMQ-EEKYYHEKPTIYHLRKELA | | 143 |
| WP_001040096 | RRRNRIRILYLQEIFAEEMSKVDDSFFHRLED-SFLV--EEDKR---G | SKYPIFATMQ-EEKYYHEKPTIYHLRKELA | | 143 |
| WP_001040097 | RRRNRIRILYLQEIFAEEMSKVDDSFFHRLED-SFLV--EEDKR---G | SKYPIFATMQ-EEKYYHEKPTIYHLRKELA | | 143 |
| WP_001040098 | RRRNRIRILYLQEIFAEEMSKVDDSFFHRLED-SFLV--EEDKR---G | SKYPIFATMQ-EEKYYHEKPTIYHLRKELA | | 143 |
| WP_001040099 | RRRNRIRILYLQEIFAEEMSKVDDSFFHRLED-SFLV--EEDKR---G | SKYPIFATMQ-EEKYYHEKPTIYHLRKELA | | 143 |
| WP_001040100 | RRRNRIRILYLQEIFAEEMSKVDDSFFHRLED-SFLV--EEDKR---G | SKYPIFATMQ-EEKYYHEKPTIYHLRKELA | | 143 |
| WP_001040104 | RRRNRIRILYLQEIFAEEMSKVDDSFFHRLED-SFLV--EEDKR---G | SKYXIFATLQ-EEKYYHEKPTIYHLRKELA | | 143 |
| WP_001040105 | RRRNRIRILYLQEIFAEEMSKVDDSFFHRLED-SFLV--EEDKR---G | SKYPIFATLQ-EEKYYHEKPTIYHLRKELA | | 143 |
| WP_001040106 | CRRNRIRILYLQEIFAEEMSKVDDSFFHRLED-SFLV--EEDKR---G | SKYPIFATLQ-EEKYYHEKPTIYHLRKELA | | 143 |
| WP_001040107 | RRRNRIRILYLQEIFAEEMSKVDDSFFHRLED-SFLV--EEDKR---G | SKYPIFATLQ-EEKDYHEKFSTIYHLRKELA | | 143 |
| WP_001040108 | RRRNRIRILYLQEIFAEEMSKVDDSFFHRLED-SFLV--EDDKR---G | SKYPIFATLQ-EEKDYHEKFSTIYHLRKELA | | 143 |
| WP_001040109 | RRRNRIRILYLQEIFAEEMSKVDDSFFHRLED-SFLV--EEDKR---G | SKYPIFATLQ-EEKDYHEKFPTIYHLRKELA | | 143 |
| WP_001040110 | RRRNRIRILYLQEIFAEEMSKVDDSFFHRLED-SFLV--EEDKR---G | SKYPIFATMQ-EEKDYHEKFPTIYHLRKELA | | 143 |
| WP_015058523 | RRRNRIRILYLQEIFAEEMSKVDDSFFHRLED-SFLV--EEDKR---G | SKYPIFATMQ-EEKDYHEKFPTIYHLRKELA | | 143 |
| WP_017643650 | RRRNRIRILYLQEIFAEEMSKVDDSFFHRLED-SFLV--EEDKR---G | SKYPIFATLQ-EEKDYHEKFPTIYHLRKELA | | 143 |
| WP_017647151 | RRRNRIRILYLQEIFAEEMSKVDDSFFHRLED-SFLV--EEDKR---G | SKYPIFATLQ-EEKYYHEKPTIYHLRKELA | | 143 |
| WP_017648376 | RRRNRIRILYLQEIFAEEMSKVDDSFFHRLED-SFLV--EEDKR---G | SKYPIFATMQ-EEKDYHEKFPTIYHLRKELA | | 143 |
| WP_017649527 | RRRNRIRILYLQEIFAEEMSKVDDSFFHRLED-SFLV--EEDKR---G | SKYPIFATMQ-EEKDYHEKFPTIYHLRKELA | | 143 |
| WP_017771611 | RRRNRIRILYLQEIFAEEMSKVDDSFFHRLED-SFLV--EEDKR---G | SKYPIFATMQ-EEKDYHEKFPTIYHLRKELA | | 143 |
| WP_017771984 | RRRNRIRILYLQEIFAEEMSKVDDSFFHRLED-SFLV--EEDKR---G | SKYPIFATMQ-EEKDYHEKFPTIYHLRKELA | | 143 |
| CFQ25032 | RRRNRIRILYLQEIFAEEMSKVDDSFFHRLED-SFLV--EEDKR---G | SKYPIFATLQ-EEKDYHEKFPTIYHLRKELA | | 143 |
| CFV16040 | RRRNRIRILYLQEIFAEEMSKVDDSFFHRLED-SFLV--EDDKR---G | SKYPIFATLQ-EEKDYHEKFPTIYHLRKELA | | 143 |
| KLJ37842 | RRRNRIRILYLQEIFAEEMSKVDDSFFHRLED-SFLV--EEDKR---G | SKYPIFATLQ-EEKDYHEKFPTIYHLRKELA | | 143 |
| KLJ72361 | RRRNRIRILYLQEIFAEEMSKVDDSFFHRLED-SFLV--EEDKR---G | SKYPIFATLQ-EEKDYHEKFPTIYHLRKELA | | 143 |
| KLL20707 | RRRNRIRILYLQEIFAEEMSKVDDSFFHRLED-SFLV--EEDKR---G | SKYPIFATLQ-EEKDYHEKFPTIYHLRKELA | | 143 |
| KLL42645 | RRRNRIRILYLQEIFAEEMSKVDDSFFHRLED-SFLV--EEDKR---G | SKYPIFATLQ-EEKDYHEKFPTIYHLRKELA | | 143 |
| WP_047202273 | RRRNRIRILYLQEIFAEEMSKVDDSFFHRLED-SFLV--EEDKR---G | SKYPIFATMQ-EEKDYHEKFPTIYHLRKELA | | 143 |
| WP_047209694 | RRRNRIRILYLQEIFAEEMSKVDDSFFHRLED-SFLV--EEDKR---G | SKYPIFATMQ-EEKDYHEKFPTIYHLRKELA | | 143 |
| WP_050198062 | RRRNRIRILYLQEIFAEEMSKVDDSFFHRLED-SFLV--EEDKR---G | SKYPIFATMQ-EEKDYHEKFPTIYHLRKELA | | 143 |
| WP_050201642 | RRRNRIRILYLQEIFAEEMSKVDDSFFHRLED-SFLV--EEDKR---G | SKYPIFATLQ-EEKDYHEKFPTIYHLRKELA | | 143 |
| WP_050204027 | RRRNRIRILYLQEIFAEEMSKVDDSFFHRLED-SFLV--EEDKR---G | SKYPIFATLQ-EEKDYHEKFPTIYHLRKELA | | 143 |
| WP_050881965 | RRRNRIRILYLQEIFAEEMSKVDDSFFHRLED-SFLV--EEDKR---G | SKYPIFATLQ-EEKDYHEKFPTIYHLRKELA | | 143 |
| WP_050886065 | RRRNRIRILYLQEIFAEEMSKVDDSFFHRLED-SFLV--EEDKR---G | SKYPIFATMQ-EEKDYHEKFPTIYHLRKELA | | 143 |
| AHN30376 | RRRNRIRILYLQEIFAEEMSKVDDSFFHRLED-SFLV--EEDKR---G | SKYPIFATLQ-EEKDYHEKFPTIYHLRKELA | | 143 |
| EAO78426 | RRRNRIRILYLQEIFAEEMSKVDDSFFHRLED-SFLV--EEDKR---G | SKYPIFATLQ-EEKDYHEKFPTIYHLRKELA | | 143 |

| | | | | |
|---|---|---|---|---|
| CCW42055 | 74 | RRRNRILYLQEIFAEEMSKVDDSFFHRLED-SFLV--EEDKR----G | SKYPIFATLQ-EEKDYHEKPTIYHLRKELA | 143 |
| WP_003041502 | 74 | RRRNRLRYLQEIFAEEMMQVDESFFQRLDD-SFLV--DEDKR----G | ERHPIFGNIA-AEVKYHDEFPTIYHLRKHLA | 143 |
| WP_037593752 | 75 | RRRNRLRYLQEIFTEEMNKVDENFFQRLDD-SFLV--EEDKQ----G | SKYPIFGTLK-EEKEYHKKKTIYHLREELA | 144 |
| WP_049516684 | 74 | RRRNRLRYLQEIFAEEMMQVDESFFQRLDD-SFLV--EEDKQ----G | SRYPIFGNIA-AEVKYHDDFPTIYHLRKHLV | 143 |
| GAD46167 | 75 | RRRNRLRYLQDIFTEEMNKVDENFFQRLDE-SFLT--DNDKN---F | SKYPIFGTLK-EEKEYHKKKTIYHLRKHLA | 144 |
| WP_018363470 | 74 | RRRNRLRYLQEIFANEMAKLDDSFFQRLEE-SFLT--EEDKK----N | DSHPIFGNLE-EEDAYHQKPTIYHLRKKLA | 143 |
| WP_003043819 | 74 | RRRNRLRYLQEIFTGEMNKVDENFFQRLDD-SFLV--DEDKR----G | ERHPIFGNLA-DEVAYHRNYPTIYHLRKKLA | 143 |
| WP_006269658 | 74 | RRRNRLRYLQEIFIEEMNKVDENFFQRLDD-SFLV--EEDKR----G | ERHPIFGNIA-AEVKYHDDFPTIYHLRRHLA | 143 |
| WP_048800889 | 74 | RRRNRLRYLQEIFSSEMSKVDDSFFHRLEE-SFLV--EEDKK----H | SKYPIFGTLK-EEKEYKEFETIYHLRKRLA | 143 |
| WP_012767106 | 74 | RRRNRIRYLQEIFSSEMSKVDDSFFHRLEE-SFLV--EEDKK----H | ERHPIFGNIV-DEVAYHEKYPTIYHLRKKLA | 143 |
| WP_014612333 | 74 | RRRNRIRYLQEIFSSEMSKVDDSFFHRLEE-SFLV--EEDKK----H | ERHPIFGNIV-DEVAYHEKYPTIYHLRKKLA | 143 |
| WP_015017095 | 74 | RRRNRIRYLQEIFSSEMSKVDDSFFHRLEE-SFLV--EEDKK----H | ERHPIFGNIV-DEVAYHEKYPTIYHLRKKLA | 143 |
| WP_015057649 | 74 | RRRNRIRYLQEIFSSEMSKVDDSFFHRLEE-SFLV--EEDKK----H | ERHPIFGNIV-DEVAYHEKYPTIYHLRKKLA | 143 |
| WP_048327215 | 74 | RRRNRLRYLQEIFSSEMSKVDDSFFHRLEE-SFLV--EEDKK----H | ERHPIFGNIV-DEVAYHEKYPTIYHLRKKLA | 143 |
| WP_049519324 | 74 | RRRNRLRYLQEIFTEEMAKVDDGFFQRLED-SPYV--LEDKE----G | NKHPIFANLA-DEVAYHKKYPTIYHLRKELV | 143 |
| WP_012515931 | 74 | RRRNRLRYLQEIFTEEMAKVDDGFFQRLED-SPYV--LEDKE----G | NKHPIFANLA-DEVAYHKKYPTIYHLRKELV | 143 |
| WP_021320964 | 74 | RRRNRLRYLKEIFTEEMAKVDDGFFQRLED-SFLT--LEDKE----G | NKHPIFANLA-DEVAYHQEPTIYHLRKELV | 143 |
| WP_037581760 | 74 | RRRNRLRPLKEIFSSEMSKVDDSFFHRLED-SFLT--DDDKT----G | DSHPIFGNKA-EEDTYHQEPPTIYHLRKHLA | 143 |
| WP_044232481 | 74 | RRRNRLRYLQEIFAEEMAKVDESFFHRLDE-SFLT--DDDKT----F | ERHPIFGNKA-EEDAYHQKPTIYHLRNYLA | 144 |
| WP_009854540 | 74 | RRRNRLRYLQEIFAEEMTKVDESFFHRLDE-SFLT--TDDKD----F | ERHPIFGNKA-DEIKYHQEPPTIYHLRKHLA | 144 |
| WP_012962174 | 75 | RRRNRLRYLQEIFANEIAKVDESFFQRLEE-SFLT--DDDKT----F | DSHPIFGNKA-EEDAYHQKPTIYHLRKYLA | 143 |
| WP_039695303 | 75 | RRRNRLRYLQEIFAKEMTKVDESFFQRLEE-SFLT--SDDKE----F | DSHPIFGNLK-DEITYHNDYPTIYHLRQTLA | 143 |
| WP_014334983 | 74 | RRKYRIKELQKIFSSEMNELDIAFFPRLSE-SFIV--SDDKE----F | ENHPIFGNLK-DEITYHNDYPTIYHLRQTLA | 143 |
| WP_003099269 | 74 | RRKYRIKELQKIFSSEMNELDIAFFPRLSE-SFLV--SDDKE----F | ENHPIFGNLK-DEITYHNDYPTIYHLRQTLA | 143 |
| AHY15608 | 74 | RRKYRIKELQKIFSSEMNELDIAFFPRLSE-SFLV--SDDKE----F | ENHPIFGNLK-DEITYHNDYPTIYHLRQTLA | 143 |
| ESR09100 | | | | |
| AGM98575 | 74 | RRKYRIKELQKIFSSEMNELDIAFFPRLSE-SFLV--SDDKE----F | ENHPIFGNLK-DEITYHNDYPTIYHLRQTLA | 143 |
| ALF27331 | 74 | RRRNRIRYLQEIFSEEMGKVDDSFFHRLED-SFIV--TEDKR----G | ERHPIFGNLE-EEVKYHENFPTIYHLRQYLA | 143 |
| WP_018372492 | 74 | RRRNRIRYLQHIFAEEMNRADENFFHRLKE-SFFV--EEDKT----Y | SKYPIFGTLE-EEKNVHKNYPTIYHLRKTLA | 143 |
| WP_045618028 | 75 | RRRNRLRYLQEIFSEEMGKVDDSFFHRLDD-SFLV--PEDKR----A | SKYPIFATLE-EEKEYHKQPPTIYHLRKHLA | 144 |
| WP_045635197 | 74 | RRRNRLRYLQEIFSEEMGKVDDSFFHRLED-SFLI--PEDKR----E | SKYPIFATLT-EEKEYHKQNPTIYHLRKQLA | 143 |
| WP_022263549 | 74 | RRRNRLRYLQEIFSEEMGKVDDSFFHRLED-SFLV--TEDKR----G | ERHPIFGNLE-EEVKYHENFPTIYHLRQYLA | 143 |
| WP_022263887 | 74 | RRRNRILYLQEIFSEEMGKVDDSFFHRLDE-SFLT--DDDKN----F | DSYPIFGNKA-EEDAYHQKPPTIYHLRKHLA | 143 |
| WP_022264920 | 74 | RRRNRILYLQEIFSEEMGKVDDSFFHRLED-SFLV--TEDKR----G | ERHPIFGNLE-EEDAYHQKPTIYHLRKHLA | 143 |
| WP_022269043 | 74 | RRRNRILYLQEIFSEEMGKVDDSFFHRLED-SFLV--TEDKR----G | ERHPIFGNLE-EEVKYHENFPTIYHLRQYLA | 143 |
| WP_022269448 | 74 | RRRNRILYLQEIFSEEMGKVDDSFFHRLED-SFLV--TEDKR----G | ERHPIFGNLE-EEVKYHENFPTIYHLRQYLA | 143 |
| WP_022271977 | 74 | RRRNRILYLQEIFSEEMGKVDDSFFHRLED-SFLV--TEDKR----G | ERHPIFGNLE-EEVKYHENFPTIYHLRQYLA | 143 |
| WP_022272766 | 74 | RRRNRILYLQEIFSEEMGKVDDSFFHRLED-SFLV--TEDKR----G | ERHPIFGNLE-EEVKYHENFPTIYHLRQYLA | 143 |
| WP_022273241 | 74 | RRRNRILYLQEIFSEEMGKVDDSFFHRLED-SFLV--TEDKR----G | ERHPIFGNLE-EEVKYHENFPTIYHLRQYLA | 143 |
| WP_022275430 | 74 | RRRNRILYLQEIFSEEMGKVDDSFFHRLED-SFLV--TEDKR----G | ERHPIFGNLE-EEVKYHENFPTIYHLRQYLA | 143 |
| WP_022276448 | 74 | RRRNRILYLQEIFAEEMSKVDDSFFHRLED-SFLV--DDDKN----F | DSHPIFGNLE-EEVKYHENFPTIYHLRQYLA | 143 |
| WP_022277050 | 74 | RRRNRILYLQEIFSEEMGKVDDSFFHRLED-SFLV--TEDKR----G | ERHPIFGNLE-EEVKYHENFPTIYHLRQYLA | 143 |
| WP_022277364 | 74 | RRRNRILYLQEIFSEEMGKVDDSFFHRLED-SFLV--TEDKR----G | ERHPIFGNLE-EEVKYHENFPTIYHLRQYLA | 143 |
| WP_022279025 | 74 | RRRNRILYLQEIFAEEMSKVDDSFFHRLED-FFLV--TEDKR----G | DSHPIFGNLE-EEVKYHENFPTIYHLRQYLA | 143 |
| WP_022279859 | 74 | RRRNRILYLQEIFSEEMGKVDDSFFHRLDE-SFLT--DDDKN----F | DSHPIFGNKA-EEDAYHQKPPTIYHLRKHLA | 143 |
| WP_022280230 | 74 | RRRNRILYLQEIFAEEMSKVDDSFFHRLED-SFLV--TEDKR----G | ERHPIFGNLE-EEVKYHENFPTIYHLRQYLA | 143 |
| WP_022281696 | 74 | RRRNRILYLQEIFAEEMSKVDDSFFHRLED-SFLV--TEDKR----G | ERHPIFGNLE-EEVKYHENFPTIYHLRQYLA | 143 |
| WP_022282247 | 74 | RRRNRILYLQEIFAEEMSKVDDSFFHRLED-SFLT--DDDKN----F | DSHPIFGNKA-EEDAYHQKPPTIYHLRKHLA | 143 |
| WP_022282906 | 74 | RRRNRILYLQEIFAEEMSKVDDSFFHRLED-SFLV--TEDKR----G | ERHPIFGNLE-EEVKYHENFPTIYHLRQYLA | 143 |
| WP_022283846 | 74 | RRRNRILYLQEIFSEEMGKVDDSFFHRLDE-SFLV--TEDKR----G | ERHPIFGNLE-EEVKYHENFPTIYHLRQYLA | 143 |
| WP_022287255 | 74 | RRRNRILYLQEIFSEEMGKVDDSFFHRLED-SFLV--TEDKR----G | ERHPIFGNLE-EEVKYHENFPTIYHLRQYLA | 143 |
| WP_022288990 | 74 | RRRNRILYLQEIFSEEMGKVDDSFFHRLED-SFLV--TEDKR----G | ERHPIFGNLE-EEVKYHENFPTIYHLRQYLA | 143 |

-continued

```
WP_002289641   74  RRRNRILYLQEIFSEEMGKVDDSFFHRLED-SFLV--TEDKR----G ERHPIFGNLE--EEVKYHENPTIYHLRQYLA  143
WP_002290427   74  RRRNRILYLQEIFSEEMGKVDDSFFHRLED-SFLV--TEDKR----G ERHPIFGNLE--EEVKYHENPTIYHLRQYLA  143
WP_002295753   74  RRRNRILYLQEIFSEEMGKVNDSFFHRLED-SFLV--TEDKR----G ERHPIFGNLE--EEVKYHENPTIYHLRQYLA  143
WP_002296423   74  RRRNRILYLQEIFSEEMGKVDDSFFHRLED-SFLV--TEDKR----G ERHPIFGNLE--EEVKYHENPTIYHLREKLA  143
WP_002304487   74  RRRNRILYLQEIFAEEMQVDDSFFHRLED-SFLV--EEDKR----G SRYPIFGTLK--EEKKYHKEPKTIYHLREKLA  143
WP_002305844   74  RRRNRILYLQEIFSEEMDKVDDSFFHRLED-SFLV--TEDKR----G ERHPIFGNLE--EEVKYHENPTIYHLRQYLA  143
WP_002307203   74  RRRNRILYLQEIFSEEMGKVDDSFFHRLED-SFLV--TEDKR----G ERHPIFGNLE--EEVKYHENPTIYHLRQYLA  143
WP_002310390   74  RRRNRILYLQEIFSEEMGKVDDSFFHRLED-SFLV--TEDKR----G ERHPIFGNLE--EEVKYHENPTIYHLRQYLA  143
WP_002352408   74  RRRNRILYLQEIFSEEMGKVDDSFFHRLED-SFLV--TEDKR----G ERHPIFGNLE--EEVKYHENPTIYHLRQYLA  143
WP_012997688   74  RRRNRILYLQEIFAEEMSKVDDSFFHRLED-SFLV--TEDKR----G ERHPIFGNLE--EEVKYHENPTIYHLRQYLA  143
WP_014677909   74  RRRNRILYLQEIFSEEMGKVNDSFFHRLED-SFLV--TEDKR----G ERHPIFGNLE--EEVKYHENPTIYHLRQYLA  143
WP_019312892   74  RRRNRILYLQEIFAEEMSKVDDSFFHRLED-SFLV--TEDKR----G ERHPIFGNLE--EEVKYHENPTIYHLRQYLA  143
WP_019313659   74  RRRNRILYLQEIFSEEMGKVDDSFFHRLED-SFLV--TEDKR----G ERHPIFGNLE--EEVKYHENPTIYHLRQYLA  143
WP_019314093   74  RRRNRILYLQEIFSEEMGKVDDSFFHRLED-SFLV--TEDKR----G ECHPIFGNLE--EEVKYHENPTIYHLRQYLA  143
WP_019315370   74  RRRNRILYLQEIFSEEMGKVDDSFFHRLED-SFLV--TEDKR----G ERHPIFGNLE--EEVKYHENPTIYHLRQYLA  143
WP_019803776   74  RRRNRILYLQEIFSEEMGKVDDSFFHRLED-SFLV--TEDKR----G ERHPIFGNLE--EEVKYHENPTIYHLRQYLA  143
WP_019805234   74  RRRNRILYLQEIFSEEMGKVDDSFFHRLED-SFLV--TEDKR----G ERHPIFGNLE--EEVKYHENPTIYHLRQYLA  143
WP_024783594   74  RRRNRILYLQEIFAEEMSKVDDSFFHRLED-SFLV--TEDKR----G ERHPIFGNLE--EEVKYHENPTIYHLRQYLA  143
WP_024784288   74  RRRNRILYLQEIFAEEMSKVDDSFFHRLED-SFLT--DDDKN----F DSHPIFGNKA--EEDAYHQKPTIYHLRKHLA  143
WP_024784666   74  RRRNRILYLQEIFAEEMSKVDDSFFHRLDE-SFLV--TEDKR----G ERHPIFGNLE--EEVKYENPTIYHLRQYLA   143
WP_024784894   74  RRRNRILYLQEIFSEEMGKVDDSFFHRLED-SFLT--DDDKN----F DSHPIFGNKA--EEDAYHQKPTIYHLRKHLA  143
WP_024786433   74  RRRNRILYLQEIFAEEMSKVDDSFFHRLED-SFLV--TEDKR----G ERHPIFGNLE--EEVKYHENPTIYHLRQYLA  143
WP_049473442   74  RRRNRILYLQEIFAEEMNKVDDSFFHRLED-SFLV--TEDKR----G ERHPIFGNLE--EEVKYHENPTIYHLRKQLA  136
WP_049474547   67  RRRNRILYLQEIFAEEMSKVDDSFFHRLED-SFLI--PEDKR----G SKYPIFATLI--EEKEYHKQPPTIYHLRKQLA  144
EMC03581       75  RRKNRLRYLQEIFAEEMNKVDSFFHRLDD-SFLI--PEDKR----G SKYPIFATLQ--EEKEYHKQPPTIYHLRKQLA  144
WP_000428612   74  RRKNRLRYLQEIFAAEMNKVDESFFHRLED-SFLV--PEDKR----G SKYPIFGTLE--EEKEYHKQPPTIYHLRKILA  144
WP_000428613   74  RRKNRLRYLQEIFAAEMNKVDESFFHRLED-SFLV--PEDKR----G SKYPIFGTLE--EEKEYHKQPPTIYHLRKILA  112
WP_049523028   43  RRINRKYLQSIFDDEMSKIDSAFFQRIKD-SFLV--PDDKN----D DRHPIFGHKN--EEKAYHDNYPTIYHLRKKLA  145
WP_003107102   76  RRKKNRLCYLRDIFESEMHTIDKHFFLRLED-SFLH--KSDKR----Y EAHPIFGTLQ--EEKAYHDNYPTIYHLRKALA  144
WP_054279288   75  RRKKNRLRYLQEIFSEEISKVDNSFFHRLED-SFLV--PEDKR----G SKYPIFATLT--EEKEYKQPPTIYHLRKQLA  144
WP_049531101   75  RRKKNRLRYLQEIFAEEMSSFFHRLDD-SFLV--PEDKR----G SKYPIFATLV--EEKEYKQPPTIYHLRKQLA  144
WP_049538452   76  RRKKNRLRYLQEIFSGEMSKVDSSFFHRLDD-SFLV--PEDKR----G SKYPIFATLV--EEKEYKQPPTIYHLRKQLA  144
WP_049549711   76  RRRYRLCQLQNIFATEMKVDDTFFQRLSE-SFFY--YQDKA----F DKHPIFGNSK--EERAYHKTYPTIYHLRKDLA  145
WP_007896501   28  RRRYRLCQLQNIFATEMKVDDTFFQRLSE-SFFY--YQDKA----F DKHPIFGNSK--EERAYHKTYPTIYHLRKDLA  97
EFR44625       74  RRRNRILYLQEIFTESMNEIDESFFHRLDD-SFLV--PEDKR----G SKYPIFATLQ--EEKEYHKQPPTIYHLRKHLA  143
WP_002897477   74  RRRNRILYLQEIFSEEISKLDSSFFHRLDE-SFLV--PEDKR----G SKYPIFATLE--EEKEYHKKFPTIYHLRKHLA  143
WP_002906454   75  RRRNRILYLQEIFSEEIGKVDSSFFHRLDD-SFLI--PEDKR----G SKYPIFATLA--EEKKYHKQPPTIYHLRKQLA  144
WP_009729476   74  RRRNRILYLQDIFSPELNQVDESFLHRLDD-SFLV--PEDKR----G ERHVIPFGNIA--DEVKYHKEPPTIYHLRKALA  143
CQR24647       75  RRRNRILYLQEIFSQEISKVDSSFFHRLDD-SFLV--PEDKR----G SKYPIFATLV--EEKEYHKKQPPTIYHLRKHLA  144
WP_000066813   75  RRKNRLRYLQEIFAEEMNKVDSFFHRLDD-SFLV--PEDKS----G SKYPIFATLA--EEKEYHKKQPPTIYHLRKHLA  144
WP_009754323   75  RRKNRLRYLQEIFAEEMNKVDSFFHRLDD-SFLV--PEDKS----G SKYPIFATLA--EEKEYHKKQPPTIYHLRKHLA  144
WP_044674937   74  RRRNRILYLQEIFAEEINKIDDSFFHRLDD-SFLIv--EDKQ----G SKHPIFGTLQ--EEKKYHKQPPTIYHLRKHLA  143
WP_044676715   74  RRRNRILYLQEIFAEEINKIDDSFFQRLDD-SFLIv--EDKQ----G SKHPIFGTLQ--EEKKYHKQPPTIYHLRKHLA  143
WP_044680361   74  RRRNRILYLQEIFAEEINKIDDSFFQRLDD-SFLIv--EDKQ----G SKHPIFGTLQ--EEKKYHKQPPTIYHLRKQLA  143
WP_044681799   74  RRRNRILYLQEIFAEEINKIDDSFFQRLDD-SFLiv--EDKQ----G SKHPIFGTLQ--EEKKYHKQPPTIYHLRKQLA  143
WP_049533112   74  RRRNRLRYLQEIFAEEMNKVDENFFQRLDD-SFLV--DEDKR----G ERHPIFGNIA--AEVKYHDDFPTIYHLRKHLA  143
WP_029909905   28  HRKFPRLRLLEDMFEKEILSKDPSFFIRLKE-AFLSpkDEQKQ---F ----LFNDKDyTDADYYEQYKTIYHLRYDLI   100
WP_065506696   61  KRRERLLRALIQDMVLEKDPTFFIRLEHtSFLD--EEDKAKy1G DNYNLFIDEDfNDYTYYHKYPTIYHLRKALC    139
AIT42264       74  RRRNRICYLQEIFSNEMAKVDSFFHRLEE-SFLKK--EEDKK---H ERHPIFGNIV--DEVAYHEKYPTIYHLRKKLV  143
WP_034440723   73  RRRPRIRELQKIFDKSMGEVDSNFFHRLDE-SFLV--EEDKE---Y SKYPIFSNEK--EDKNYDKYPTIYHLRKDLA   142
AKQ21048       74  RRRNRICYLQEIFSNEMAKVDDSFFHRLEE-SFLV--EEDKL----H ERHPIFGNIV--DEVAYHEKYPTIYHLRKKLV  143
WP_004636532   74  RRRNRLIYLQDIFQQPMLAIDENFFHRLDD-SFFV--PDDKS----Y DRHPIFGSLE--EEVAYHNTYPTIYHLRKHLA  143
WP_002364836   74  RRRNRLRYLQAFFEEAMTDLDENFFARLQE-SFLV--PEDKK----W HRHPIFAKLE--DEVAYHETYPTIYHLRKKLA  143
```

```
WP_016631044                                                                                   25 RRRNRLRYLQAFFEEAMTDLDENFFARLQE-SFLV--PEDKK---W HRHPIFAKLE-DEVAYHETYPTIYHLRKKLA  94
EMS755795                                                                                         
WP_002373311                                                                                   74 RRRNRLRYLQAFFEEAMTDLDENFFARLQE-SFLV--PEDKK---W HRHPIFAKLE-DEVAYHETYPTIYHLRKKLA 143
WP_002378009                                                                                   74 RRRNRLRYLQAFFEEAMTALDENFFARLQE-SFLV--PEDKK---W HRHPIFAKLE-DEVAYHETYPTIYHLRKKLA 143
WP_002407324                                                                                   74 RRRNRLRYLQAFFEEAMTALDENFFARLQE-SFLV--PEDKK---W HRHPIFAKLE-DEVAYHETYPTIYHLRKKLA 143
WP_002413717                                                                                   74 RRRNRLRYLQAFFEEAMTDLDENFFARLQE-SFLV--PEDKK---W HRHPIFAKLE-DEVAYHETYPTIYHLRKKLA 143
WP_010775580                                                                                   74 RRRNRLRYLQAFFEEAMTALDENFFARLQE-SFLV--PEDKK---W HRHPIFAKLE-DEVAYHETYPTIYHLRKKLA 143
WP_010818269                                                                                   74 RRRNRLRYLQAFFEEAMTALDENFFARLQE-SFLV--PEDKK---W HRHPIFAKLE-DEVAYHETYPTIYHLRKKLA 143
WP_010824395                                                                                   74 RRRNRLRYLQAFFEEAMTDLDENFFARLQE-SFLV--PEDKK---W HRHPIFAKLE-DEVAYHETYPTIYHLRKKLA 143
WP_016622645                                                                                   74 RRRNRLRYLQAFFEEAMTALDENFFARLQE-SFLV--PEDKK---W HRHPIFAKLE-DEVAYHETYPTIYHLRKKLA 143
WP_033624816                                                                                   74 RRRNRLRYLQAFFEEAMTALDENFFARLQE-SFLV--PEDKK---W HRHPIFAKLE-DEVAYHETYPTIYHLRKKLA 143
WP_033625576                                                                                   74 RRRNRLRYLQAFFEEAMTALDENFFARLQE-SFLV--PEDKK---W HRHPIFAKLE-DEVAYHETYPTIYHLRKKLA 143
WP_033789179                                                                                   74 RRRNRLRYLQAFFEEAMTALDENFFARLQE-SFLV--PEDKK---W HRHPIFAKLE-DEVAYHETYPTIYHLRKKLA 143
WP_002310644                                                                                   74 RRRQRILELQKIFAPEILKIDEHFFARLNE-SFLV--LDEKK---Q SRHPVFATIK-QEKSYHQTYPTIYHLRQALA 143
WP_002312694                                                                                   74 RRRQRILELQKIFAPEILKIDEHFFARLNE-SFLV--PDEKK---Q SRHPVFATIK-QEKSYHQTYPTIYHLRQALA 143
WP_002314015                                                                                   74 RRRQRILELQKIFAPEILKIDEHFFARLNE-SFLV--LDEKK---Q SRHPVFATIK-QEKSYHQTYPTIYHLRQALA 143
WP_002320716                                                                                   74 RRRQRILELQKIFAPEILKIDEHFFARLNE-SFLV--LDEKK---Q SRHPVFATIK-QEKSYHQTYPTIYHLRQALA 143
WP_002330729                                                                                   74 RRRQRILELQKIFAPEILKIDEHFFARLNE-SFLV--LDEKK---Q SRHPVFATIK-QEKSYHQTYPTIYHLRQALA 143
WP_002335161                                                                                   74 RRRQRILELQKIFAPEILKIDEHFFARLNE-SFLV--LDEKK---Q SRHPVFATIK-QEKSYHQTYPTIYHLRQALA 143
WP_002345439                                                                                   74 RRRQRILELQKIFAPEILKIDEHFFARLNE-SFLV--LDEKK---Q SRHPVFATIK-QEKSYHQTYPTIYHLRQALA 143
WP_034867970                                                                                   74 RRKYRLSKIQDLFAEELCKQDDCFFVRLEE-SFLV--PEEKQ---Y KPASIFPTLE-EEKEYYQKYPTIYHLRQKLV 143
WP_047937432                                                                                   74 RRRQRILELQKIFAPEILKIDEHFFARLNE-SFLV--LDEKK---Q SRHPVFATIK-QEKSYHQTYPTIYHLRQALA 143
WP_010720994                                                                                   74 RRKYRLSKIQDLFAEELCKQDDCFFVRLEE-SFLV--PEEKQ---Y KPASIFPTLE-EEKEYYQKYPTIYHLRQKLV 143
WP_010737004                                                                                   74 RRKYRLSKIQDLFAEELCKQDDCFFVRLEE-SFLV--PEEKQ---Y KPASIFPTLE-EEKEYYQKYPTIYHLRQKLV 143
WP_034700478                                                                                   74 RRKYRLSKIQDLFAEELCKQDDCFFVRLEE-SFLV--PEEKQ---Y KPASIFPTLE-EEKEYYQKYPTIYHLRQKLV 143
WP_007209003                                                                                   74 RRRNRICYLQEIFQPEMNHLDNNFFYRLNE-SFLVa--DDAK---Y DKHPIFGTLD-EEIHFHEQPPTIYHLRKYLA 143
WP_023519017                                                                                   74 RRRQRVLAIQDIFAEEIHKKDPNFFARLEE-GDRV--EADKR---F AKPPVFATLS-EEKNYHRQYPTIYHRHDLA 143
WP_010770040                                                                                   74 RRRNRLRCRLQDLFTEEMNQVDANFHRLQE-SFLV--PDEKE---F ERHAIPGKME-EEVSYYREPPTIYLRKHLA 143
WP_048604708                                                                                   74 RRRQRISYLQTFFQEEMNRIDPNFFNRLDE-SFLI--BEDKL---S ERHPIFGTIE-EEVAYHKNYATIYHLRKELA 143
WP_010750235                                                                                   74 RRKYRILELQKIFSEELLKKDSHFFARLDE-SFLV--PEDKQ---Y ARFPIFPTLL-EEKAYYQNYPTIYHLRQKLA 143
AII16583                                                                                      113 RRKYRILELQKIFSEELLKKDSHFFARLDE-SFLV--EEDKKH---H ERHPIFGNIV-DEVAYHDKYPTIYHLRKKLV 182
WP_029073316                                                                                   66 KRRERIRLLRGIMEDMVLDVDPTFFIRLANvSFLD--QEDKKGy1K SNYNLFIDKDfNDKTYDKYPTIYHLRKHLC 144
WP_031589969                                                                                   66 KRRERIRLLREIMEDMVLDVDPTFFIRLANvSFLD--QEDKKGy1K SNYNLFIDKDfNDKTYDKYPTIYHLRKHLC 144
KDA45870                                                                                       75 RRRNRLRYLQEIFAPALAKVDPNFFYRLEE-SSLVa--EDKK---Y DVYPIFGKRE-EELLYHDTHKTIYHLRSELA 144
WP_039099354                                                                                   62 RRKWRLGLLREIFEPYITPVDDTFFLRKKQ-SNLS--PKDQR---K -QTSLFNDRT--DRAFYDDYPTIYHLRYKLM 132
AKP02966                                                                                       65 RRKNRINWLNEIFSEELANTDPSFLIRLQN-SWVSkKDPDRK---R DKYNLFIDNPyTDKEYYREPPTIFHLRKELI 137
WP_010991369                                                                                   74 RRRNRISYLQIFAEEMSKTDANFFCRLSD-SFYV--DNEKR---N SRHPFFATIE-EEVEYHKNYPTIFHLREELV 143
WP_033838504                                                                                   74 RRRNRISYLQIFAEEMSKTDANFFCRLSD-SFYV--DNEKR---N SRHPFFATIE-EEVAYHKNYPTIYHLREELV 143
EHN60060                                                                                       77 RRRNRISYLQIFAEEMSKTDANFFCRLSD-SFYV--DNEKR---N SRHPFFATIE-EEVAYHKNYPTIYHLREELV 146
EFR89594                                                                                          
WP_038409211                                                                                   74 RRRNRIAYLQEIFAAEMAEVDANFFYRLED-SFYI--ESEKR---H SRHPFFATIE-EEVAYHEEYKTIYHLREKLV 143
EFR95520                                                                                          
WP_003723650                                                                                   74 RRRNRISYLQEIFAVEMANIDANFFCRLND-SFYV--DSEKR---N SRHPFFATIE-EEVAYHDNYRTIYHLREKLV 143
WP_003727705                                                                                   74 RRRNRISYLQEIFAVEMANIDANFFCRLND-SFYV--DSEKR---N SRHPFFATIE-EEVAYHKNYRTIYHLREELV 143
WP_003730785                                                                                   74 RRRNRISYLQEIFAVEMANIDANFFCRLND-SFYV--DSEKR---N SRHPFFATIE-EEVAYHKNYRTIYHLREELV 143
WP_003733029                                                                                   74 RRRNRISYLQEIFAIQMNEVDDNFFNRLKE-SFYA--ESDKK---Y NRHPFFGTVE-EEVAYYKDPPTIYHLRKELI 143
WP_003739838                                                                                   74 RRRNRISYLQEIFALEMANIDANFFCRLND-SFYV--DSEKR---N SRHPFFATIE-EEVAYHKNYRTIYHLREELV 143
WP_014601172                                                                                   74 RRRNRISYLQEIFAVEMANIDANFFCRLND-SFYV--DSEKR---N SRHPFFATIE-EEVAYHKNYRTIYHLREELV 143
WP_023548323                                                                                   74 RRRNRISYLQEIFAVEMANIDANFFCRLND-SFYV--DSEKR---N SRHPFFATIE-EEVAYHKNYRTIYHLREELV 143
WP_031665337                                                                                   74 RRRNRISYLQEIFAIQMNEVDDNFFNRLKE-SFYA--ESDKK---Y NRHPFFGTVE-EEVAYYKDPPTIYHLRKELI 143
WP_031669209                                                                                   74 RRRNRISYLQEIFAVEMANIDANFFCRLND-SFYV--DSEKR---N SRHPFFATIE-EEVAYHKNYRTIYHLREELV 143
WP_033920898                                                                                   74 RRRNRISYLQEIFAVEMANIDANFFCRLND-SFYV--DSEKR---N NRHPFFATIE-EEVAYHKNYRTIYHLREELV 143
AKI42028                                                                                       77 RRRNRISYLQEIFAVEMANIDANFFCRLND-SFYV--DSEKR---N SRHPFFATIE-EEVAYHKNYRTIYHLREELV 146
```

```
-continued

AKI50529          77  RRRNRISYLQEIPAVEMANIDANFFCRLND-SFYV--DSEKR---N SRHPFFATIE-EEVAYHKNYRTIYHLREELV                          146
EFR83390          74  RRRNRISYLQEIFTAEMPEVDANFFYRLED-SFYI--ESEKR---Q SRHPFFATIE-EEVAYHENYRTIYHLREKLV                          143
WP_046323366      90  RRKNRICYLQEIFSNEMAKVDDSFFHRLEE-SFLV--EEDKK---H ERHPIFGNIV-DEVAYHEKYPTIYHLRKKLV                          159
AKE81011          65  KRRERIRLLRALLQDMVLEKDPTFFIRLEHtSPLD--EEDKAkylG DNYNLFIDEdfNDYTYYHKPTIYHLRKALC                          143
CUO82355          66  KRRERIRLLRDLLGDMVMEVDPTFFFIRLLNvSFLD--EEDKQkm1G DNYNLFIEKDfNDKTYYDKYPTIYHLRKELC                          144
WP_033162887     107  RRKNRICYLQEIFSNEMAKVDDSFFHRLEE-SFLV--EEDKK---H ERHPIFGNIV-DEVAYHEKYPTIYHLRKKLV                          176
AGZ01981          74  RRKNRICYLQEIFSNEMAKVDDSFFHRLEE-SFLV--EEDKK---H ERHPIFGNIV-DEVAYHEKYPTIYHLRKKLV                          143
AKA60242          74  RRRNRICYLQEIFSNEMAKVDDSFFHRLEE-SFLV--EEDKK---H ERHPIFGNIV-DEVAYHEKYPTIYHLRKKLV                          143
AKS40380          78  RRKNRICYLQEIFSNEMAKVDDSFFHRLEE-SFLV--EEDKK---H ERHPIFGNIV-DEVAYHEKYPTIYHLRKKLV                          147
4UN5_B           144  DSTDKADLRLIYLALAHMIKFRGHFLIEGD-LNPDNSDvDKL--FIQLVQTYNQL--FEEN-- INASGVDAK----AI                        211
WP_010922251     145  DSSEKADLRLVYLALAHMIKFRGHFLIEGD-LNAENTDVQKI--FADFVGVNRT--FDDS-H LSEITVDVA---SI                          212
WP_039695303     144  DSKEKTDLRLIYLALAHMIKYRGHFLYEEA-FDIKNNDIQKI--FNEFISIYDNT-FEGS-S LSGQNAQVE---AI                          211
WP_045635197     105  EEEFSA------------VHNV--NEVE---              -EDT---              -GN------                           134
5AXW_A           144  -------ALLHLAKRRG---                                                                                   
WP_009880683     144  DSTDKADLRLIYLALAHMIKFRGHFLIEGD-LNPDNSDVDKL--FIQLVQTYNQL--FEEN-- INASGVDAK----AI                        211
WP_010922251     144  DSTDKADLRLIYLALAHMIKFRGHFLIEGD-LNPDNSDVDKL--FIQLVQTYNQL--FEEN-- INASGVDAK----AI                        211
WP_011054416     144  DSTDKVDLRLIYLALAHMIKFRGHFLIEGD-LNPDNSDVDKL--FIQLVQTYNQL--FEEN-- INASRVDAK----AI                        211
WP_011284745     144  DSTDKADLRLIYLALAHMIKFRGHFLIEGD-LNPDNSDVDKL--FIQLVQTYNQL--FEEN-- INASGVDAK----AI                        211
WP_011285506     144  DSTDKADLRLIYLALAHMIKFRGHFLIEGD-LNPDNSDVDKL--FIQLVQTYNQL--FEEN-- INASGVDAK----AI                        211
WP_011527619     144  DSTDKADLRLIYLALAHMIKFRGHFLIEGD-LNPDNSDVDKL--FIQLVQTYNQL--FEEN-- INASGVDAK----AI                        211
WP_012560673     144  DSTDKADLRLIYLALAHMIKFRGHFLIEGD-LNPDNSDVDKL--FIQLVQTYNQL--FEEN-- INASGVDAK----AI                        211
WP_014407541     144  DSTDKADLRLIYLALAHMIKFRGHFLIEGD-LNPDNSDVDKL--FIQLVQIYNQL--FEEN-- INASGVDAK----AI                        211
WP_020905136     144  DSTDKADLRLIYLALAHMIKFRGHFLIEGD-LNPDNSDVDKL--FIQLVQTYNQL--FEEN-- INASGVDAK----AI                        211
WP_023080005     144  DSTDKVDLRLIYLALAHMIKFRGHFLIEGD-LNPDNSDVDKL--FIQLVQTYNQL--FEEN-- INASGVDAK----AI                        211
WP_023610282     144  DSTDKADLRLIYLALAHMIKFRGHFLIEGD-LNPDNSDVDKL--FIQLVQTYNQL--FEEN-- INASRVDAK----AI                        211
WP_030125963     144  DSTDKADLRLIYLALAHMIKFRGHFLIEGD-LNPDNSDVDKL--FIQLVQTYNQL--FEEN-- INASGVDAK----AI                        211
WP_030126706     144  DSTDKVDLRLIYLALAHMIKFRGHFLIEGD-LNPDNSDVDKL--FIQLVQTYNQL--FEEN-- INASRVDAK----AI                        211
WP_031488318     144  DSTDKADLRLIYLALAHMIKFRGHFLIEGD-LNPDNSDVDKL--FIQLVQTYNQL--FEEN-- INASGVDAK----AI                        211
WP_032460140     144  DSTDKADLRLIYLALAHMIKFRGHFLIEGD-LNPDNSDVDKL--FIQLVQTYNQL--FEEN-- INASGVDAK----AI                        211
WP_032461047     144  DSTDKADLRLIYLALAHMIKFRGHFLIEGD-LNPDNSDVDKL--FIQLVQTYNQL--FEEN-- INASGVDAK----AI                        211
WP_032462016     144  DSTDKADLRLIYLALAHMIKFRGHFLIEGG-LNPDNSDVDKL--FIQLVQTYNQL--FEEN-- INANGVDAK----AI                        211
WP_032462936     144  DSTDKADLRLIYLALAHMIKFRGHFLIEGD-LNPDNSDVDKL--FIQLVQTYNQL--FEEN-- INASGVDAK----AI                        211
WP_032464890     144  DSTDKADLRLIYLALAHMIKFRGHFLIEGD-LNPDNSDVDKL--FIQLVQTYNQL--FEEN-- INASGVDAK----AI                        211
WP_033888930       1  ---------------------------PDNSDVDKL--FIQLVQTYNQL--FEEN--                                              36
WP_038431314     144  DSTDKADLRLIYLALAHMIKFRGHFLIEGD-LNPDNSDVDKL--FIQLVQTYNQL--FEEN-- INASGVDAK----AI                        211
WP_038432938     144  DSTDKVDLRLIYLALAHMIKFRGHFLIEGD-LNPDNSDVDKL--FKDFVEVYDKT-VEES-H LSEMTVDAL---SI                          211
WP_038434062     144  DSTDKADLRLIYLALAHMIKFRGHFLIEGD-LNPDNSDVDKL--FADFVGVRDT--FDDS-H LSEITVDAA---SI                          211
BAQ51233         144  DSTDKADLRLIYLALAHMIKFRGHFLIEGD-LNPDNSDVDKL--FIQLVQTYNQL--FEEN-- INASGVDAK----AI                        214
KGE60162          55  -------------------------------------------                                                            122
KGE60856           -  -------------------------------------------                                                            -
WP_002989955     144  DISQKADLRLIVYLALAHMIKFRGHFLIEGQ-LNPDNSDVDKL--FIQLVQTYNQL--FEEN-- INASGVDAK----AI                        211
WP_003030002     144  DSSEKADLRLVYLALAHMIKFRGHFLIEGE-LNAENTNVQAL--LKAENTNVQAL--FEEN-H LSEMTVDAL---SI                        211
WP_003065552     147  DKQEKADLRLIVYLALAHMIKFRGHFLIEDDrFDVRNTDIQKQ--YQAPLEIFDTT--FENN-D LLSQNVDVE---AI                        214
WP_001040076     144  DKQEKADLRLIVYLALAHMIKFRGHFLIEDDfFDVRNTDIQKQ--YQAPLEIFDTT--FENN-D LLSQNVDVE---AI                        212
WP_001040078     144  DKKEKADLRLIYIALAHIIKFRGHFLIEDDsFDVRNTDISKQ--YQDFLEIFNTT--FENN-D LLSQNVDVE---AI                        212
WP_001040080     144  DKKEKADLRLIYIALAHIIKFRGHFLIEDDsFDVRNTDISKQ--YQDFLEIFNTI--FENN-D LLSQNVDVE---AI                        212
WP_001040081     144  DKKEKADLRLIYIALAHIIKFRGHFLIEDDsFDVRNTDISKQ--YQDFLEIFNTT--FENN-D LLSQNVDVE---AI                        212
WP_001040083     144  DKKEKADLRLIYIALAHIIKFRGHFLIEDDsFDVRNTDISKQ--YQDFLEIFNTT--FENN-D LLSQNVDVE---AI                        212
WP_001040085     144  DKKEKADLRLIYIALAHIIKFRGHFLIEDDsFDVRNTDISKQ--YQDFLEIFNTT--FENN-D LLSQNVDVE---AI                        212
WP_001040087     144  DKKEKADLRLIYIALAHIIKFRGHFLIEDDsFDVRNTDISKQ--YQDFLEIFNTT--FENN-D LLSQNVDVE---AI                        212
WP_001040088     144  DKKEKADLRLIYIALAHIIKFRGHFLIEDDsFDVRNTDISKQ--YQDFLEIFNTT--FENN-D LLSQNVDVE---AI                        212
WP_001040089     144  DKKEKADLRLIYIALAHIIKFRGHFLIEDDsFDVRNTDISKQ--YQDFLEIFNTT--FENN-D LLSQNVDVE---AI                        212
WP_001040090     144  DKKEKADLRLIYIALAHIIKFRGHFLIEDDsFDVRNTDISKQ--YQDFLEIFNTT--FENN-D LLSQNVDVE---AI                        212
```

-continued

| | | | | |
|---|---|---|---|---|
| WP_001040091 | 144 | DKKEKADLRLIYLALAHIIKFRGHFLIEDDSFDVRNTDIQKQ--YQDFLEIFDTT--FENN-D | LLSQNVDVE----AI | 212 |
| WP_001040092 | 144 | DKKEKADLRLIYLALAHIIKFRGHFLIEDDrFDVRNTDIQKQ--YQAFLEIFDTS--FENN-H | LLSQNVDVE----AI | 212 |
| WP_001040094 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040095 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040096 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040097 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040098 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040099 | 144 | DKKEKADLRLIYLALAHIIKFRGHFLIEDDrFDVRNTDIQKQ--YQAFLEIFDTT--FENN-D | LLSQNVDVE----AI | 212 |
| WP_001040100 | 144 | DKKEKADLRLIYLALAHIIKFRGHFLIEDDSFDVRNTDIQKQ--YQDFLEIFNTT--FENN-D | LLSQNVDVE----AI | 212 |
| WP_001040104 | 144 | DKKEKADLRLIYLALAHIIKFRGHFLIEDDSFDVRNTDISKQ--YQDFLEIFDTS--FENN-D | LLSQNVDVE----AI | 212 |
| WP_001040105 | 144 | DKKEKADLRLIYLALAHIIKFRGHFLIEDDSFDVRNTDIQKQ--YQDFLEIFDTT--FENN-D | LLSQNVDVE----AI | 212 |
| WP_001040106 | 144 | DKKEKADLRLIYLALAHIIKFRGHFLIEDDSFDVRNTDIQKQ--YQAFLEIFNTT--FENN-D | LLSQNIDVE----GI | 212 |
| WP_001040107 | 144 | DKKEKADLRLIYLALAHIIKFRGHFLIEDDSFDVRNTDIQRQ--YQAFLEIFDTT--FENN-D | LLSQNIDVE----GI | 212 |
| WP_001040108 | 144 | DKKEKADLRLVYLALAHIIKFRGHFLIEDDSFDVRNTDIQRQ--YQAFLEIFDTT--FENN-D | LLSQNIDVE----GI | 212 |
| WP_001040109 | 144 | DKKEKADLRLIYLALAHIIKFRGHFLIEDDSFDVRNTDIQRQ--YQAFLEIFDTT--FENN-D | LLSQNIDVE----GI | 212 |
| WP_001040110 | 144 | DKKEKANLRLVYLALAHIIKFRGHFLIEDDSFDVRNTDIQRQ--YQAFLEIFDTT--FENN-H | LLSQNIDVE----GI | 212 |
| WP_015058523 | 144 | DKKEKADLRLIYLALAHIIKFRGHFLIEDDSFDVRNTDIQRQ--YQAFLEIFDTS--FENN-D | LLSQNIDVE----GI | 212 |
| WP_017643650 | 144 | DKKEKADLRLIYLALAHIIKFRGHFLIEDDSFDVRNTDIQRQ--YQAFLEIFDTT--FENN-D | LLSQNIDVE----GI | 212 |
| WP_017647151 | 144 | DKKEKADLRFYLALAHIIKFRGHFLIEDDSFDVRNTDIQRQ--YQAFLEIFDTT--FENN-D | LLSQNIDIE----GI | 212 |
| WP_017648376 | 144 | DKKEKADLRLIYLALAHIIKFRGHFLIEDDSFDVRNTDIQRQ--YQAFLEIFDTT--FENN-D | LLSQNIDVE----GI | 212 |
| WP_017649527 | 144 | DKKEKADLRLVYLALAHIIKFRGHFLIEDDSFDVRNTDISKQ--YQDFLEIFNTT--FENN-D | LLSQNVDVE----GI | 212 |
| WP_017771611 | 144 | DKKEKADLRLVYLALAHIIKFRGHFLIEDDSFDVRNTDISKQ--YQAFLEIFDTT--FENN-D | LLSQNVDVE----AI | 212 |
| WP_017771984 | 144 | DKKEKADLRLIYLALAHIIKFRGHFLIEDDSFDVRNTDISKQ--YQDFLEIFNTT--FENN-D | LLSQNIDVE----AI | 212 |
| CFQ25032 | 144 | DKKEKADLRLIYLALAHIIKFRGHFLIEDDSFDVRNTDIQRQ--YQAFLEIFNTT--FENN-D | LLSQNIDVE----GI | 212 |
| CFV16040 | 144 | DKKEKADLRLVYLALAHIIKFRGHFLIEDDSFDVRNTDIQKQ--YQDFLEIFDTT--FENN-D | LLSQNVDVE----AI | 212 |
| KLJ37842 | 144 | DKKEKANLRLVYLALAHIIKERGHFLIEDDSFDVRNTDIQKQ--YQDFLEIENTT--FENN-D | LLSQNVDVE----AI | 212 |
| KLJ72361 | 144 | DKKEKADLRLIYLALAHIIKERGHFLIEDDSFDVRNTDIQKQ--YQAFLEIFDTT--FENN-D | LLSQNIDVE----GI | 212 |
| KLL20707 | 144 | DKKEKADLRLVYLALAHIIKERGHFLIEDDSFDVRNTDIQKQ--YQDFLEIENTT--FENN-D | LLSQNIDVE----AI | 212 |
| KLL42645 | 144 | DKKEKANLRLVYLALAHIIKERGHFLIEDDSFDVRNTDIQRQ--YQAFLEIFDTT--FENN-D | LLSQNIDVE----GI | 212 |
| WP_047207273 | 144 | DKKEKADLRLIYLALAHIIKERGHFLIEDDSFDVRNTDISKQ--YQDFLEIENTT--FENN-D | LLSQNVDVE----AI | 212 |
| WP_047209694 | 144 | DKKEKADLRLVYLALAHIIKERGHFLIEDDSFDVRNTDIQKQ--YQAFLEIFDTT--FENN-D | LLSQNVDVE----AI | 212 |
| WP_050198062 | 144 | DKKEKADLRLIYLALAHIIKERGHFLYEDDSFDVRNTDISKQ--YQDFLEIENTT--FENN-D | LLSQNVDVE----AI | 212 |
| WP_050201642 | 144 | DKKEKANLRLVYLALAHIIKERGHFLIEDDSFDVRNTDISKQ--YQDFLEIENTT--FENN-D | LLSQNVDVE----AI | 212 |
| WP_050204027 | 144 | DKKEKADLRLIYLALAHIIKERGHFLIEDDSFDVRNTDISKQ--YQAFLEIFDTT--FENN-D | LLSQNIDVE----AI | 212 |
| WP_050881965 | 144 | DKKEKADLRLIYLALAHIIKERGHFLIEDDSFDVRNTDISKQ--YQDFLEIENTT--FENN-D | LLSQNVDVE----GI | 212 |
| WP_050886065 | 144 | DKKEKADLRLIYLALAHIIKERGHFLIEDDSFDVRNTDISKQ--YQAFLEIFDTT--FENN-D | LLSQNVDVE----AI | 212 |
| AHN30376 | 144 | DKKEKADLRLVYLALAHIIKERGHFLIEDDSFDVRNTDIQKQ--YQAFLEIFDTS--FENN-D | LLSQNVDVE----AI | 212 |
| EA078426 | 144 | DKKEKADLRLIYLALAHMIKERGHFLIEDDrEDVRNTDIQKQ--YQAFLEIFDTT--FENN-D | LLSQNVDVE----AI | 212 |
| CCW42055 | 144 | DISQKADLRLIYLALAHMIKERGHFLIEGQ--LKAENTNVQAL--FKDEVEVDKT--VEES-H | LSEITVDAL----SI | 211 |
| WP_003041502 | 144 | DISQKADLRLIYLALAHMIKERGHFLIEGQ--LKAENTNVQAL--FKDEVEEYDKT-IEES-H | LSEITVDAL----SI | 212 |
| WP_037593752 | 145 | NSKEKADLRLIYLALAHMIKERGHFLIEGQ--LKAENTNVQAL--FKDEVEVDKT--IEES-H | LSEMTVDAL----SI | 212 |
| WP_049516684 | 144 | DISQKADLRLVYLALAHMIKERGHFLYEGD--LKAENTNVQAL--FKDEVEEYDKT-VEES-H | LSEMTVDAL----SI | 212 |
| GAD46167 | 145 | NSKEKADLRLIYLALAHMIKERGHFLIEGD--LKAENTDVQAL--FKDEVEEYDKT-IEES-H | LSEITVDAL----SI | 212 |
| WP_018363470 | 144 | DSTEKADLRLIVYLALAHMIKERGHFLIEGE--LNAENTDVQKL--FTDEVGVDRT-FDDS-H | LSEITVDAA----SI | 211 |
| WP_003043819 | 144 | DSPEKADLRLIYLALAHMIKERGHFLIEGK--LNAENSDVAKL--FYQLIQTYNQL-FEES- | LDEIEVDAK----GI | 212 |
| WP_006299658 | 144 | DTSKKADLRLIYLALAHMIKERGHFLIEGD--LKAENTDVQAL--FYQLIQTYNQL-FEES- | LSEITVDAL----SI | 211 |
| WP_048800889 | 144 | DSTGKVDLRLIYLALAHMIKERGHFLIEGQ--LKAENTDVQTL--ENDEVEVDKT--FEEN- | LAEITVDAL----GI | 212 |
| WP_012767106 | 144 | DSTDKADLRLIYLALAHMIKERGHFLIEGD--LNPDNSDMDKL--FIQLVQTYNQL-FEEN- | INASRVDAK----AI | 211 |
| WP_014612333 | 144 | DSTDKADLRLIYLALAHMIKERGHFLIEGD--LNPDNSDMDKL--FIQLVQTYNQL-FEEK- | INASRVDAK----AI | 211 |
| WP_015017095 | 144 | DSTDKADLRLIYLALAHMIKERGHFLIEGD--LNPDNSDVDKL--FIQLVQTYNQL-FEEN- | INASRVDAK----AI | 211 |
| WP_015057649 | 144 | DSTDKADLRLIYLALAHMIKERGHFLIEGD--LNPDNSDMDKL--FIQLVQTYNQL-FEEN- | INASRVDAK----AI | 211 |
| WP_048272215 | 144 | DSTDKADLRLIYLALAHMIKERGHFLIEGD--LNPDNSDMDKL--FIQLVQTYNQL-FEEN- | INASRVDAK----AI | 211 |
| WP_049519324 | 144 | DSTDKADLRLIYLALAHMIKERGHFLIEGD--LNPDNSDVDKL--FIQLVQTYNQL-FEEN- | INASRVDAK----AI | 211 |

| | | | |
|---|---|---|---|
| WP_012515931 | 144 | DNPQKADLRLIYLAVAHIIKERGHFLIEGT-LSSKNNNLQKS--FDHLVDTYNLL--FEEQ----LLTEGINAK---EL | 211 |
| WP_021320964 | 144 | DNPQKADLRLIYLAVAHIIKERGHFLIEGT-LSSKNNNLQKS--FDHLVDTYNLL--FEEQ----LLTEGINAK---EL | 211 |
| WP_037581760 | 144 | DNPQKADLRLIYLAVAHIIKERGHFLIEGT-LSSKNNNLQKS--FDHLVDTYNLL--FEEQ----LLTEGINAK---EL | 211 |
| WP_004232481 | 144 | DSPEKVDLRLIYLALAHMIKERGHFLIEGQ-LNAENTDVQKI--FADEVGVYDRT--FDDS-H--LSEITVDAA---SI | 211 |
| WP_009854540 | 145 | DSSEKADLRLIYLALAHMIKYRGHFLIEGK-LNAENTDVQKL--FTDEVGVYDRT--FDDS-N--LSEITVDVA---ST | 212 |
| WP_012962174 | 145 | DSHEKADLRLIYLALAHMIKERGHFLIEGE-LNAENTDVQKL--FEAFVEVYDRT--FDDS-N--LSEITVDAS---SI | 212 |
| WP_039695303 | 144 | DSSEKADLRLVYLALAHMIKFRGHFLIEGE-LNAENTDVQKI--FADFVGVNRT--FDDS-H--LSEITVDVA---SI | 212 |
| WP_014334983 | 144 | DSQBKADLRLIYLALAHMIKYRGHFLIEGE-LNAENTDVQKL--FNVFVETYDKI--VDES-H--LSEIEVDAS---SI | 211 |
| WP_003099269 | 144 | DSDQKADLRLIYLALAHIIKFRGHFLIEGN-LDSENTDVHVL--FLNLVNIYNNL--FEED-----VETASIDAE---KI | 211 |
| AHY15608 | 144 | DSDQKADLRLIYLALAHIIKFRGHFLIEGN-LDSENTDVHVL--FLNLVNIYNNL--FEED-----VETASIDAE---KI | 211 |
| AHY17476 | 144 | DSDQKADLRLIYLALAHIIKFRGHFLIEGN-LDSENTDVHVL--FLNLVNIYNNL--FEED-----VETASIDAE---KI | 211 |
| ESR09100 | | | |
| AGM98575 | 144 | DSDQKADLRLIYLALAHIIKFRGHFLIEGN-LDSENTDVHVL--FLNLVNIYNNL--FEED-----VETASIDAE---KI | 211 |
| ALF27331 | 144 | DNPEKTDLRLVYLALAHIIKFRGHFLIEGK-FDTRNNDVQRL--FQEFLAVYDNT--FENS-S--LQEQNVQVE---EI | 211 |
| WP_018372492 | 144 | DTPDKMDIRLIYLALAHIIKYRGHFLIEGD-LDIENIGIQDS--FKSFIEEYNTQ--FGTK----LDSTTKVE---AI | 209 |
| WP_045618028 | 145 | DSKEKADFRLIYLALAHIIKYRGHFLYESS-EDIKNNDIQKI--FNEFISIYDNT--FEGS-S--LNGQNAQVE---AI | 212 |
| WP_045635197 | 144 | DSKEKTDLRLIYLALAHMIKFRGHFLIEGK-FDIKNNDIQKI--FNEFISIYDNT--FEGS-S--LSGQNAQVE---AI | 211 |
| WP_002263549 | 144 | DNPEKVDLRLVYLALAHIIKFRGHFLIEGK-FDTRNNDVQRL--FQEFLAVYDNT--FENS-S--LQEQNVQVE---EI | 211 |
| WP_002263887 | 144 | DNPEKVDLRLVYLALAHIIKFRGHFLIEGK-FDTRNNDVQRL--FQEFLAVYDNT--FENS-S--LQEQNVQVE---EI | 211 |
| WP_002264920 | 144 | DSTEKADLRLVYLALAHIIKFRGHFLIEGE-LNAENTDVQKL--FADFVGVYDRT--FDDS-H--LSEITVDAS---SI | 211 |
| WP_002269043 | 144 | DNPEKTDLRLVYLALAHIIKFRGHFLIEGK-FDTRNNDVQRL--FQEFLAVYDNT--FENS-S--LQEQNVQVE---EI | 211 |
| WP_002269448 | 144 | DNPEKVDLRLVYLALAHIIKFRGHFLIEGK-FDTRNNDVQRL--FQEFLAVYDNT--FENS-S--LQEQNVQVE---EI | 211 |
| WP_002271977 | 144 | DNPEKVDLRLVYLALAHIIKFRGHFLIEGK-FDTRNNDVQRL--FQEFLAVYDNT--FENS-S--LQEQNVQVE---EI | 211 |
| WP_002272766 | 144 | DNPEKVDLRLVYLALAHIIKFRGHFLIEGK-FDTRNNDVQRL--FQEFLAVYDNT--FENS-S--LQEQNVQVE---EI | 211 |
| WP_002273241 | 144 | DNPEKVDLRLVYLALAHIIKFRGHFLIEGK-FDTRNNDVQRL--FQEFLAVYDNT--FENS-S--LQEQNVQVE---EI | 211 |
| WP_002275430 | 144 | DNPEKVDLRLVYLALAHIIKFRGHFLIEGK-FDTRNNDVQRL--FQEFLAVYDNT--FENS-S--LQEQNVQVE---EI | 211 |
| WP_002276448 | 144 | DNPEKVDLRLVYLALAHIIKFRGHFLIEGK-FDTRNNDVQRL--FQEFLAVYDNT--FENS-S--LQEQNVQVE---EI | 211 |
| WP_002277050 | 144 | DSTEKADLRLVYLALAHIIKFRGHFLIEGE-LNAENTDVQKL--FADFVGVYDRT--FDDS-H--LSEITVDAS---SI | 211 |
| WP_002277364 | 144 | DNPEKVDLRLVYLALAHIIKFRGHFLIEGK-FDTRNNDVQRL--FQEFLAVYDNT--FENS-S--LQEQNVQVE---EI | 211 |
| WP_002279025 | 144 | DNPEKVDLRLVYLALAHIIKFRGHFLIEGK-FDTRNNDVQRL--FQEFLAVYDNT--FENS-S--LQEQNVQVE---EI | 211 |
| WP_002279859 | 144 | DNPEKVDLRLVYLALAHIIKFRGHFLIEGK-FDTRNNDVQRL--FADFVGVYDRT--FDDS-H--LSEITVDAS---SI | 211 |
| WP_002280230 | 144 | DNPEKVDLRLVYLALAHIIKFRGHFLIEGK-FDTRNNDVQRL--FQEFLAVYDNT--FENS-S--LQEQNVQVE---EI | 211 |
| WP_002281696 | 144 | DNPEKVDLRLVYLALAHIIKFRGHFLIEGK-FDTRNNDVQRL--FADFVGVYDRT--FDDS-H--LSEITVDAS---SI | 211 |
| WP_002282247 | 144 | DSTEKADLRLVYLALAHIIKFRGHFLIEGE-LNAENTDVQKL--FADFVGVYDRT--FDDS-H--LSEITVDAS---SI | 211 |
| WP_002282906 | 144 | DNPEKVDLRLVYLALAHIIKFRGHFLIEGK-FDTRNNDVQRL--FQEFLAVYDNT--FENS-S--LQEQNVQVE---EI | 211 |
| WP_002283846 | 144 | DNPEKTDLRLVYLALAHIIKFRGHFLIEGK-FDTRNNDVQRL--FQEFLAVYDNT--FENS-S--LQEQNVQVE---EI | 211 |
| WP_002287255 | 144 | DNPEKVDLRLVYLALAHIIKFRGHFLIEGK-FDTRNNDVQRL--FQEFLAVYDNT--FENS-S--LQEQNVQVE---EI | 211 |
| WP_002288990 | 144 | DNPEKVDLRLVYLALAHIIKFRGHFLIEGK-FDTRNNDVQRL--FQEFLAVYDNT--FENS-S--LQEQNVQVE---EI | 211 |
| WP_002289641 | 144 | DNPEKVDLRLVYLALAHIIKFRGHFLIEGK-FDTRNNDVQRL--FQEFLAVYDNT--FENS-S--LQEQNVQVE---EI | 211 |
| WP_002290427 | 144 | DNPEKVDLRLVYLALAHIIKFRGHFLIEGK-FDTRNNDVQRL--FQEFLAVYDNT--FENS-S--LQEQNVQVE---EI | 211 |
| WP_002295753 | 144 | DNPEKVDLRLVYLALAHIIKFRGHFLIEGK-FDTRNNDVQRL--FQEFLAVYDNT--FENS-S--LQEQNVQVE---EI | 211 |
| WP_002296423 | 144 | NSTEKADLRLVYLsLAHMIKFGGHFLIEGQ-LKAENTNVQAL--FKDFVEVYDKT--VEES-H--LSEMTVDAL---SI | 211 |
| WP_002304487 | 144 | DNPEKVDLRLVYLALAHIIKFRGHFLIEGK-FDTRNNDVQKL--FQEFLAVYDNT--FENS-S--LQEQNVQVE---EI | 211 |
| WP_002305844 | 144 | DNPEKVDLRLVYLALAHIIKFRGHFLIEGK-FDTRNNDVQKL--FQEFLAVYDNT--FENS-S--LQEQNVQVE---EI | 211 |
| WP_002307203 | 144 | DNPEKVDLRLVYLALAHIIKFRGHFLIEGK-FDTRNNDVQKL--FQEFLAVYDNT--FENS-S--LQEQNVQVE---EI | 211 |
| WP_002310390 | 144 | DNPEKTDLRLVYLALAHIIKFRGHFLIEGK-FDTRNNDVQRL--FQEFLAVYDNT--FENS-S--LQEQNVQVE---EI | 211 |
| WP_002352408 | 144 | DNPEKVDLRLVYLALAHIIKFRGHFLIEGK-FDTRNNDVQRL--FQEFLAVYDNT--FENS-S--LQEQNVQVE---EI | 211 |
| WP_012997688 | 144 | DNPEKVDLRLVYLALAHIIKFRGHFLIEGK-FDTRNNDVQRL--FQEFLAVYDNT--FENS-S--LQEQNVQVE---EI | 211 |
| WP_014677909 | 144 | DNPEKVDLRLVYLALAHIIKFRGHFLIEGK-FDTRNNDVQRL--FQEFLAVYDNT--FENS-S--LQEQNVQVE---EI | 211 |
| WP_019312892 | 144 | DNPEKVDLRLVYLALAHIIKFRGHFLIEGK-FDTRNNDVQKL--FQEFLAVYDNT--FENS-S--LQEQNVQVE---EI | 211 |
| WP_019313659 | 144 | DNPEKVDLRLVYLALAHIIKFRGHFLIEGK-FDTRNNDVQKL--FQEFLAVYDNT--FENS-S--LQEQNVQVE---EI | 211 |
| WP_019314093 | 144 | DNPEKVDLRLVYLALAHIIKFRGHFLIEGK-FDTRNNDVQKL--FQEFLAVYDNT--FENS-S--LQEQNVQVE---EI | 211 |
| WP_019315370 | 144 | DNPEKTDLRLVYLALAHIIKFRGHFLIEGK-FDTRNNDVQNT--FQEFLAVYDNT--FENS-S--LQEQNVQVE---EI | 211 |

```
                                                   -continued-

WP_019803776  144 DNPEKVDLRLIVYLALAHIIKFRGHFLIEGK-FDTRNNDVQRL--FQEFLAVDNT--FENS-S LQEQNVQVE---EI 211
WP_019805234  144 DNPEKTDLRLIVYLALAHIIKFRGHFLIEGK-FDTRNNDVQRL--FQEFLAVDNT--FENS-S LQEQNVQVE---EI 211
WP_024783594  144 DNPEKVDLRLIVYLALAHIIKFRGHFLIEGK-FDTRNNDVQRL--FQEFLAVDNT--FENS-S LQEQNVQVE---EI 211
WP_024784288  144 DSTEKADLRIVYLALAHMIKFRGHFLIEGE-LNAENTDVQKL--FADFVGVDRT--FDDS-H LSEITVDAS---SI 211
WP_024784666  144 DNPEKVDLRLIVYLALAHIIKFRGHFLIEGK-FDTRNNDVQRL--FQEFLAVDNT--FENS-S LQEQNVQVE---EI 211
WP_024784894  144 DNPEKTDLRLIVYLALAHMIKFRGHFLIEGK-FDTRNNDVQRL--FQEFLAVDNT--FENS-S LQEQNVQVE---EI 211
WP_024786433  144 DSTEKADLRLVYLALAHMIKFRGHFLIEGE-LNAENTDVQKL--FADFVGVDRT--FDDS-H LSEITVDAS---SI 211
WP_049473442  144 DNPEKVDLRLIVYLALAHIIKFRGHFLIEGK-FDTRNNDVQRL--FQEFLAVDNT--FENS-S LQEQNVQVE---EI 211
WP_049474547  144 DNPEKTDLRLIVYLALAHIIKFRGHFLIEGK-FDTRNNDVQRL--FQEFLAVDNT--FENS-S LQEQNVQVE---EI 211
EMC03581      137 DNPEKTDLRLIVYLALAHMIKFRGHFLIEGK-FDTRNNDVQRL--FQEFLAVDNT--FEGN-S LSGQNVQVE---AI 204
WP_000428612  145 DSKEKTDLRLIYLALAHMIKYRGHFLYEDT-FDIKNNDIQKI--FNEFISIYNNT--FEGS-S LSGQNAQVE---AI 212
WP_000428613  145 DSKEKVDLRLIIYLALAHMIKYRGHFLYEDS-FDIKNNDIQKI--FSEFISIYDNT--FEES-S LSKGNAQVE---EI 212
WP_049523028  144 DSDEKADLRLIYLALAHIIKFRGHFLIEGD-LDSQNTDVNAL--FLKLVDTYNLM--FEDD- IDTQTIDAT---VI 211
WP_003107102  113 DSDEKADLRLIYLALAHIIKFRGHFLIEGA-LSANNTDVQQL--VHALVDAYNIM--FEED- LDIEAIDVK---AI 180
WP_054279288  146 DSTEKADLRLIYLTLAHMIKYRGHFLYEES-FDIKNNDIQKI--FNEFISIYDNT--FEGS-S LSGQNAQVE---AI 213
WP_049531101  145 DSKEKADLRLIYLALAHMIKYRGHFLYEEA-FDIKNNDIQKI--FNEFISIYDNT--FEGS-S LSGQNAQVE---AI 212
WP_049538452  145 DSKEKADLRLIYLALAHMIKYRGHFLYEEA-FDIKNNDIQKI--FNEFINIYDNT--FEGS-S LSGQNEQVE---TI 212
WP_049549711  145 DSKEKADLRLIYLALAHMIKYRGHFLYEGK-LNSENTDVQKL--FNEFISIYDNT--FEGS-S LSGQNAQVE---AI 212
WP_007896501  146 DRDQKADLRLIYLALSHIIKFRGHFLIEGK-LNSENDVQKL--FIALVTVYNLL--FEEE- IAGETCDAK---AL 213
EFR44625       98 DSKEKSDVRLIYLALAHMIKYRGHFLYEET-FDIKNNDIQKI--FIALVTVYNLL--FEEE- IAGETCDAK---AL 165
WP_002897477  144 DSKEKTDLRLIYLALAHMIKYRGHFLYEES-FDIKNNDIQKI--FNEFINIYDNT--FEGS-S LSGQNAQVE---AI 211
WP_002906454  144 DSKEKTDLRLIYLALAHMIKYRGHFLYEEA-FDIKNNDIQKI--FNEFISIYDNT--FEGS-S LSGQNAQVE---AI 211
WP_009729476  145 DSKEKTDLRLIYLALAHMIKYRGHFLYEEA-FDIKNNDIQKI--FNEFISIYNNT--FEGN-S LSGQNVQVE---AI 212
CQR24647      144 DSSEKADLRLIYLALAHMIKYRGHFLIDEP-IDIRNMNSQNL--FKEFLLAPDGI--QVDC-Y LASKHTDIS---GI 211
WP_000066813  145 DSKEKTDLRLIYLALAHIIKFRGHFLYEES-FDIKNNDIQKI--FSEFISIYDNT--FEGK-S LSGQNAQVE---AI 212
WP_009754323  145 DSKEKADLRLIYLALAHIIKFRGHFLYEEA-FDIKNNDIQKI--FNEFINIYDNT--FEGS-S LSGQNAQVE---AI 212
WP_044674937  144 DSSQKADIRLIYLALAHMIKYRGHELFEGD-LKSENKDVQHL--FNDEVEMFDKT--VEGS-Y LSENLPNVA---DV 211
WP_044676715  144 DSSQKADLRLIYLALAHMIKYRGHFLFEGD-LKSENKDVQHL--FNDEVEMFDKT--VEGS-Y LSENLPNVA---DV 211
WP_044680361  144 DSSQKADIRLIYLALAHMIKYRGHELFEGD-LKSENKDVQHL--FNDEVEMFDKT--VEGS-Y LSENLPNVA---DV 211
WP_044681799  144 DSSQKADIRLIYLALAHMIKYRGHFLFEGD-LKSENKDVQHL--FNDEVEMFDKT--VEGS-Y LSENLPNVA---DV 211
WP_049533112  144 DISQKADLRLVYLALAIHHLLIKYRGHFLYEGQ-LKAENTNVQAL--FKDEVEVYDKT--VEES-H LSEMTVDAL---SI 211
WP_029090905  101 SQHRQFDIREVYLAIHHLIKYRGHFLYEDtFTTDGNQLQHH--IKAIITMINST1---NR- IIPETIDINvfeKI 171
WP_006506696  140 ESTEKADPDLRLIYLALHHIVKYRGNFLYEGQkFNMDASNIEDK--LSDIFTQFTSFmniPYEdD --KKNLEIL---EI 210
AIT42264      144 DSTDKADLRLIYLALAHMIKERGHFLIEGD-LNPDNSDVDKL--FIQLVQTNQL--FEEN- INASGVDAK---AI 211
AKQ21048      143 DSNQKADLRLIYLALAHMIKERGHFLIEGD-LKMDGISISES-FQEFIDSYNEVcaLEDE-N NDELLTQIE---NI 217
WP_034440723  144 DSTDKADLRLIYLALAHMIKERGHFLIEGD-LNPDSDVDKL--FIQLVQTNQL--FEEN- INASGVDAK---AI 211
WP_004636532  144 DNPEKADLRLIYTLALAHIVKYRGHFLIEGE-LNTENTISET--FEQFLDTYSDI--FKEQ- LVGDISKVE---EI 210
WP_002364836  144 DSSEQADLRLIYLALAHMIKYRGHFLIEGK-LSTENISVKEQ--FQQFMIIYNQT--FVNGES PLPESVLIE---EE 217
WP_016631044   95 DSSEQADLRLIYLALAHMIKYRGHFLIEGK-LSTENISVKDQ--FQQFMIIYNQT--FVNGES PLPESVLIE---EE 168
EMS75795      --- --------------------------------------------------------------------- ---
WP_002373311  144 DSSEQADLRLIYLALAHMIKYRGHFLIEGK-LSTENTSVKEQ--FQQFMIIYNQT--FVNGES PLPESVLIE---EE 217
WP_002378009  144 DSSEQADLRLIYLALAHMIKYRGHFLIEGK-LSTENISVKEQ--FQQFMIIYNQT--FVNGES PLPESVLIE---EE 217
WP_002407324  144 DSSEQADLRLIYLALAHMIKYRGHFLIEGK-LSTENISVKEK--FQQFMIIYNQT--FVNGeG PLPESVLIE---EE 217
WP_002413717  144 DSSEQADLRLIYLALAHIVKYRGHFLIEGK-LSTENISVKDQ--FQQFMIIYNQT--FVNGeS PLPESVLIE---EE 217
WP_010775580  144 DNPEKADLRLIYLALAHIVKYRGHFLIEGE-LNTENTISET--FEQFLDTYSDI--FKEQ- LVGDISKVE---EI 210
WP_010818269  144 DSSEQADLRLIYLALAHMIKYRGHFLIEGK-LSTENISVKEQ--FQQFMIIYNQT--FVNGES PLPESVLIE---EE 217
WP_010824395  144 DSSEQADLRLIYLALAHMIKYRGHFLIEGK-LSTENTSVKDQ--FQQFMIIYNQT--FVNGES PLPESVLIE---EE 217
WP_016622645  144 DSSEQADLRLIYLALAHMIKYRGHFLIEGK-LSTENISVKDQ--FQQFMIIYNQT--FVNGES PLPESVLIE---EE 217
WP_033624816  144 DSSEQADLRLIYLALAHMIKYRGHFLIEGK-LSTENISVKDQ--FQQFMIIYNQT--FVNGES PLPESVLIE---EE 217
WP_033625576  144 DSSEQADLRLIYLALAHMIKYRGHFLIEGK-LSTENISVKEQ--FQQFMIIYNQT--FVNGES PLPESVLIE---EE 217
WP_033789179  144 DSSEQADLRLIYLALAHMIKYRGHFLIEGK-LSTENISVKEQ--FQQFMIIYNQT--FVNGES PLPESVLIE---EE 217
WP_002310644  144 DSSEKADIRLVYLAMAHLLKYRGHFLIEGE-LNTENSSVTET--FRQFLSTYNQQ--FSEA-D KLDEAVDCS---FV 216
WP_002312694  144 DSSEKADIRLVYLAMAHLLKYRGHFLIEGE-LNTENSVSVTET--FRQFLSTYNQQ--FSEA-G KLDEAVDCS---FV 216
```

-continued

| | | | |
|---|---|---|---|
| WP_002314015 | 144 | DSSEKADIRLVYLAMAHLLKYRGHFLIEGE-LNTENSSVTET--FRQFLSTNQQ--FSEA-D KLDEAVDCS---FV | 216 |
| WP_002320716 | 144 | DSSEKADIRLVYLAMAHLLKYRGHFLIEGE-LNTENSSVTET--FRQFLSTNQQ--FSEA-D KLDEAVDCS---FV | 216 |
| WP_002330729 | 144 | DSSEKADIRLVYLAMAHLLKYRGHFLIEGE-LNTENSSVTET--FRQFLSTNQQ--FSEA-D KLDEAVDCS---FV | 216 |
| WP_002335161 | 144 | DSSEKADIRLVYLAMAHLLKYRGHFLIEGE-LNTENSSVTET--FRQFLSTNQQ--FSEA-D KLDEAVDCS---FV | 216 |
| WP_002345439 | 144 | DSSEKADIRLVYLAMAHLLKYRGHFLIEGE-LNTENSSVTET--FRQFLSTNQQ--FSEA-D KLDEAVDCS---FV | 216 |
| WP_034867970 | 144 | DSTEKEDIRLVYLAMAHLLKYRGHFLFEGE-LDTKNTSIEES--FRVFLEQYSKQ--SDQP--LIVHQPVL---TI | 209 |
| WP_047937432 | 144 | DSSEKADIRLVYLAMAHLLKYRGHFLIEGE-LNTENSSVTET--FRQFLSTNQQ--FSEA-D KLDEAVDCS---FV | 216 |
| WP_010720994 | 144 | DSTKGDDRLVYLAMAHLLKYRGHFLFEGD-LDTENTSIEES--FRVFLEQYGKQ--SDQP--LIVHQPVL---TI | 209 |
| WP_010737004 | 144 | DSTEKEDIRLVYLALAHLLKYRGHFLFEGD-LDTENTSIEES--FRVFLEQYGKQ--SDQP--LIVHQPVL---TI | 209 |
| WP_010737478 | 144 | DSTEKEDIRLVYLALAHLLKYRGHFLFEGD-LDTENTSIEES--FRVFLEQYGKQ--SDQP--LIVHQPVL---TI | 209 |
| WP_007209003 | 144 | DGDEKADIRLVYLAIAHLIKFRGNFLIEGE-LNTENNSVIELs--KVFVQLNQT1-SELE--FIDESIDFS---EV | 214 |
| WP_023519017 | 144 | NSKEQADIRLVYLAIAHCLKYRGHFLFEGE-LDTENTSVTEN--YQQFLQAYQQF--FPEP--IGDLDDAV---PI | 209 |
| WP_010770040 | 144 | DTSEQADIRLVYLALAHIKYRGHFLIEGE-LNTENSSVSET--FRTFIQVYNQI--FRENe--PLAVPDNIE---EL | 212 |
| WP_048604708 | 144 | DAEEKADRLVYLALAHLIKYRGHFLIEGR-LSTENTSTEET--FKITFLQKTNQT--FN---PVDETISIG---SI | 208 |
| WP_010750235 | 144 | DSTEKADIRLVYLALAHMIKYRGHFLFEGE-LDTENTSVEET--FKEFIDIYNEQ--FEEG---IIFYKDIP---LI | 209 |
| AII16583 | 183 | DSTDKADRLIYLALAHMIKYRGHFLIEGD-LNPDNSDVDKL--FIQLVQTYNQL--FEEN---INASGVDAK---AI | 250 |
| WP_029073316 | 145 | ESKEKEDPRLIYLALMHIVKYRGNFLYEGQkFSMDVSNIEDK--MIDVLRQFNEIn1FEYveD--KKIDEVL---NV | 215 |
| WP_031589969 | 145 | ESKEKEDPRLIYLALMHIVKYRGNFLYEGQkFSMDVSNIEDK--MIDVLRQFNEIn1FEYveD--KKIDEVL---NV | 215 |
| KDA45870 | 145 | NNDRPADLRLVYLALAHIIKYRGNELLEGE-IDLRTTDINKV--FAEFSETLNEN--SDENiG KLDVA---DI | 209 |
| WP_039099354 | 133 | TEKRQFDIREIYLAMHHIVKYRGHFLNEAPaVSSEKSSEINLVahFDRLNTIFADL-FSESgF-TDKLAEVK---AL | 206 |
| AKP02966 | 138 | INKNKADIRLVYLALHNILKYRGHFTYEHQkFNISTLNSNLS--KELIELNNQQLikYDIS--FPDNCDWNhisDI | 208 |
| WP_010991369 | 144 | NSSEKADLRLVYLALALAHIIKYRGHFLIEGA-LDTQNTSVDGI--YKQFIQTYNQV--FASGiE KLEDNKDVA---KI | 217 |
| WP_033838504 | 144 | NSSEKADLRLVYLALALAHIIKYRGHFLIEGA-LDTQNTSVDGI--YKQFIQTYNQV--FASGiE KLEDNKDVA---KI | 217 |
| EHN60060 | 147 | NSSEKADLRLVYLALALAHIIKYRGHFLIEGA-LDTQNTSVDGI--YKQFIQTYNQV--FASGiE KLEDNKDVA---KI | 220 |
| EFR89594 | | | |
| WP_038409211 | 144 | NSSDKADLRLVYLALALAHIIKYRGHFLIEGM-LDTKNTSVDEV--FKQFIQTYNQI--FASDiE RLEENKEVA---EI | 217 |
| EFR95520 | | | |
| WP_003723650 | 144 | NSSEKADLRLVYLALALAHIIKYRGNFLIEGA-LDTKNTSVDEV--YKQFIETYNQV--FMSNiE KVEENIEVA---NI | 217 |
| WP_003727705 | 144 | NSSEKADLRLVYLALALAHIIKYRGNFLIEGA-LDTKNTSVDEV--YKQFIQTYNQV--FMSNiE KVEENTEVA---SI | 217 |
| WP_003730785 | 144 | NSSEKADLRLVYLALALAHIIKYRGNFLIEGA-LDTKNTSVDEV--YKQFIQTYNQV--FMSNiE KVEENTEVA---SI | 217 |
| WP_003733029 | 144 | DSQKKADLRLVYLALALAHIIKYRGNFLIEGA-LDTKNTSIDEM--FKQFLQIYNQV--FANDiE KTEKNQEVA---QI | 217 |
| WP_003739838 | 144 | NSSEKADLRLVYLALALAHIIKYRGNFLIEGA-LDTKNTSVDEM--YKQFIQTYNQV--FISNiE KMEENTTVA---DI | 217 |
| WP_014601172 | 144 | NSSEKADLRLVYLALALAHIIKYRGNFLIEGA-LDTKNTSVDGV--YEQFIQTYNQV--FMSNiE KVEENIEVA---NI | 217 |
| WP_023548323 | 144 | NSSEKADLRLVYLALALAHIIKYRGNFLIEGA-LDTKNTSVDGV--YEQFILTNQV--FMSNiE KVEENIEVA---NI | 217 |
| WP_031666537 | 144 | NSSEKADLRLVYLALALAHIIKYRGNFLIEGA-LDTKNTSIDEM--FKQFLQIYNQV--FANDiE KTEKNQEVA---QI | 217 |
| WP_031669209 | 144 | DSQKKADLRLVYLALALAHIIKYRGNFLIEGA-LDTKNTSVDGV--YEQFIQTYNQV--FMSNiE KVEENIEVA---NI | 217 |
| WP_033920898 | 144 | NSSEKADLRLVYLALALAHIIKYRGNFLIEGA-LDTKNTSVDGV--YEQFIQTYNQV--FMSNiE KVEENIEVA---NI | 217 |
| AKI42028 | 147 | NSSEKADLRLVYLALALAHIIKYRGNFLIEGA-LDTKNTSVDGV--YEQFIQTYNQV--FMSNiE KVEENIEVA---NI | 220 |
| AKI50529 | 147 | NSSEKADLRLVYLALALAHIIKYRGNFLIEGA-LDTKNTSVDGV--YEQFIQTYNQV--FMSNiE KVEENIEVA---NI | 220 |
| EFR83390 | | | |
| WP_046323366 | 144 | NSSDKADLRLVYLALALAHIIKYRGNFLIGK-LDTKNTSVDEV--FKQFIKTYNQV--FASDiE RIEENNEVA---KI | 217 |
| AKE81011 | 160 | DSTDKADRLIYLALAHMIKYRGHFLIEGD-LNPDNSDVDKL--FIQLVQTYNQL--FEEN---INASGVDAK---AI | 227 |
| CUO82355 | 144 | ESTEKADPRLIIYLALHHIVKYRGNFLIKY-Y-PT EKKNTLFGNLIALGLQPNFKTNF--KLsED-A---KLQ--FSKDTYEDLEE | 214 |
| WP_033162887 | 145 | ENKEKADPRLIALAHMIIKYRGNFLYEGQkFNMDASNIEDK--LSDVFTQFADFmIPYEdd---SDINSMI---AV | 215 |
| AGZ01981 | 177 | DSTDKADLRLIYLALAHMIKYRGHFLIEGD-LNPDNSDVDKL--FIQLVQTYNQL--FEEN---INASGVDAK---AI | 244 |
| AKA60242 | 144 | DSTDKADLRLIYLALAHMIKYRGHFLIEGD-LNPDNSDVDKL--FIQLVQTYNQL--FEEN---INASGVDAK---AI | 211 |
| AKS40380 | 144 | DSTDKADLRLIYLALAHMIKYRGHFLIEGD-LNPDNSDVDKL--FIQLVQTYNQL--FEEN---INASGVDAK---AI | 211 |
| 4UN5_B | 148 | DSTDKADLRLIYLALAHMIKYRGHFLIEGD-LNPDNSDVDKL--FIQLVQTYNQL--FEEN---INASGVDAK---AI | 215 |
| WP_010922251 | 212 | LSAR-LSKSRRLENLIAQ-L-PG EKKNGLFGNLIALSLGLTPNFKSNF--DLAED-A---KLQ--LSKDTYDDDLDN | 277 |
| WP_039695303 | 213 | LTEK-ISKSRRLENLIKY-Y-PT EKKNTLFGNLIALALGLQPNFKTNF--KLsED-A---KLQ--FSKDTYEDLEE | 278 |
| WP_045635197 | 212 | FTDK-ISKSAKRERVLKL-F-PD EKSTGLFSEFLKLIVGNQADFKKHF--DLEDK-A---PLQ--FSKDTYEDLEN | 277 |
| 5AXW_A | 135 | LSTK--------EQISRN-s--K --------------------------LEEKyVa---ELQ--------------- | 157 |
| WP_009880683 | | | |

```
WP_010922251    212 LSAR-LSKSRRLENLIAQ-L-PG EKKNGLFGNLIALSLGLTPNFKSNF--DLAED-A---KLQ-LSKDTYDDDLDN 277
WP_011054416    212 LSAR-LSKSRRLENLIAQ-L-PG EKKNGLFGNLIALSLGLTPNFKSNF--DLAED-A---KLQ-LSKDTYDDDLDN 277
WP_011284745    212 LSAR-LSKSRRLENLIAQ-L-PG EKKNGLFGNLIALSLGLTPNFKSNF--DLAED-A---KLQ-LSKDTYDDDLDN 277
WP_011285506    212 LSAR-LSKSRRLENLIAQ-L-PG EKKNGLFGNLIALSLGLTPNFKSNF--DLAED-A---KLQ-LSKDTYDDDLDN 277
WP_011527619    212 LSAR-LSKSRRLENLIAQ-L-PG EKKNGLFGNLIALSLGLTPNFKSNF--DLAED-A---KLQ-LSKDTYDDDLDN 277
WP_012560673    212 LSAR-LSKSRRLENLIAQ-L-PG EKKNGLFGNLIALSLGLTPNFKSNF--DLAED-A---KLQ-LSKDTYDDDLDN 277
WP_014407541    212 LSAR-LSKSRRLENLIAQ-L-PG EKRNGLFGNLIALSLGLTPNFKSNF--DLAED-A---KLQ-LSKDTYDDDLDN 277
WP_020905136    212 LSAR-LSKSRRLENLIAQ-L-PG EKKNGLFGNLIALSLGLTPNFKSNF--DLAED-A---KLQ-LSKDTYDDDLDN 277
WP_023080005    212 LSAR-LSKSRRLENLIAQ-L-PG EKKNGLFGNLIALSLGLTPNFKSNF--DLAED-A---KLQ-LSKDTYDDDLDN 277
WP_023610282    212 LSAR-LSKSRRLENLIAQ-L-PG EKKNGLFGNLIALSLGLTPNFKSNF--DLAED-A---KLQ-LSKDTYDDDLDN 277
WP_030125963    212 LSAR-LSKSRRLENLIAQ-L-PG EKKNGLFGNLIALSLGLTPNFKSNF--DLAED-A---KLQ-LSKDTYDDDLDN 277
WP_030126706    212 LSAR-LSKSRRLENLIAQ-L-PG EKKNGLFGNLIALSLGLTPNFKSNF--DLAED-A---KLQ-LSKDTYDDDLDN 277
WP_031488318    212 LSAR-LSKSRRLENLIAQ-L-PG EKKNGLFGNLIALSLGLTPNFKSNF--DLAED-A---KLQ-LSKDTYDDDLDN 277
WP_032460140    212 LSAR-LSKSRRLENLIAQ-L-PG EKKNGLFGNLIALSLGLTPNFKSNF--DLAED-A---KLQ-LSKDTYDDDLDN 277
WP_032461047    212 LSAR-LSKSRRLENLIAQ-L-PG EKRNGLFGNLIALSLGLTPNFKSNF--DLAED-A---KLQ-LSKDTYDDDLDN 277
WP_032462016    212 LSAR-LSKSRRLENLIAQ-L-PG EKRNGLFGNLIALSLGLTPNFKSNF--DLAED-A---KLQ-LSKDTYDDDLDN 277
WP_032462936    212 LSAR-LSKSRRLENLIAQ-L-PG EKKNGLFGNLIALSLGLTPNFKSNF--DLAED-A---KLQ-LSKDTYDDDLDN 277
WP_032464890    212 LSAR-LSKSRRLENLIAQ-L-PG EKKNGLFGNLIALSLGLTPNFKSNF--DLAED-A---KLQ-LSKDTYDDDLDN 277
WP_033888930    37  LSAR-LSKSRRLENLIAQ-L-PG EKKNGLFGNLIALSLGLTPNFKSNF--DLAED-A---KLQ-LSKDTYDDDLDN 102
WP_038431314    212 LSAR-LSKSRRLENLIAQ-L-PG EKKNGLFGNLIALSLGLTPNFKSNF--DLAED-A---KLQ-LSKDTYDDDLDN 277
WP_038432938    212 LSAR-LSKSRRLENLIAQ-L-PG EKKNGLFGNLIALSLGLTPNFKSNF--DLAED-A---KLQ-LSKDTYDDDLDN 277
WP_038434062    212 LSAR-LSKSRRLENLIAQ-L-PG EKRNGLFGNLIALLLGLTPNFKSNF--DLAED-T---KLQ-LSKDTYDDDLDN 277
BAQ51233        123 LSAR-LSKSRRLENLIAQ-L-PG EKKNGLFGNLIALSLGLTPNFKSNF--DLAED-A---KLQ-LSKDTYDDDLDN 188
KGE60162                ------------------------------------------------------------------------
KGE60856        212 LSAR-LSKSRRLENLIAQ-L-PG EKKNGLFGNLIALSLGLTPNFKSNF--DLAED-A---KLQ-LSKDTYDDDLDN 277
WP_002989955    212 LTEK-VSKSRRLENLIAH-Y-PA EKKNTLFGNLIALSLGLQPNFKTNF--QLSED-A---KLQ-FSKDTYEDDLEG 277
WP_003030002    215 LTEK-ISKSRRLENLIKY-Y-PT EKKNTLFGNLIALALGLQPNFKMNF--KLSED-A---KLQ-FSKDSYEEDLGE 280
WP_003065552    213 LTDK-ISKSAKKDRILAQ-Y-PN QKSTGIFAEFLKLIVGNQADFKKHF--NLEDK-T---PLQ-FAKDSYDEDLEN 278
WP_001040076    213 LTDK-ISKSAKKDRILAQ-Y-PN QKSTGIFAEFLKLIVGNQADFKKHF--NLEDK-T---PLQ-FAKDSYDEDLEN 278
WP_001040078    213 LTDK-ISKSAKKDRILAQ-Y-PN QKSTGIFAEFLKLIVGNQADFKKYF--NLEDK-T---PLQ-FAKDSYDEDLEN 278
WP_001040080    213 LTDK-ISKSAKKDRILAQ-Y-PN QKSTGIFAEFLKLIVGNQADFKKYF--NLEDK-T---PLQ-FAKDSYDEDLEN 278
WP_001040081    213 LTDK-ISKSAKKDRILAQ-Y-PN QKSTGIFAEFLKLIVGNQADFKKYF--NLEDK-T---PLQ-FAKDSYDEDLEN 278
WP_001040083    213 LTDK-ISKSAKKDRILAQ-Y-PN QKSTGIFAEFLKLIVGNQADFKKYF--NLEDK-T---PLQ-FAKDSYDEDLEN 278
WP_001040085    213 LTDK-ISKSAKKDRILAQ-Y-PN QKSTGIFAEFLKLIVGNQADFKKHF--NLEDK-T---PLQ-FAKDSYDEDLEN 278
WP_001040087    213 LTDK-ISKSAKKDRILAQ-Y-PN QKSTGIFAEFLKLIVGNQADFKKHF--NLEDK-T---PLQ-FAKDSYDEDLEN 278
WP_001040088    213 LTDK-ISKSAKKDRILAR-Y-PN QKSTGIFAEFLKLIVGNQADFKKHF--NLEDK-T---PLQ-FAKDSYDEDLEN 278
WP_001040089    213 LTDK-ISKSAKKDRILAR-Y-PN QKSTGIFAEFLKLIVGNQADFKKHF--NLEDK-T---PLQ-FAKDSYDEDLEN 278
WP_001040090    213 LTDK-ISKSAKKDRILAR-Y-PN QKSTGIFAEFLKLIVGNQADFKKYF--NLEDK-T---PLQ-FAKDSYDEDLEN 278
WP_001040091    213 LTDK-ISKSAKKDRILAQ-Y-PN QKSTGIFAEFLKLIVGNQADFKKYF--NLEDK-T---PLQ-FAKDSYDEDLEN 278
WP_001040092    213 LTDK-ISKSAKKDRILAQ-Y-PN QKSTGIFAEFLKLIVGNQADFKKYF--NLEDK-T---PLQ-FAKDSYDEDLEN 278
WP_001040094    213 LTDK-ISKSAKKDRILAR-Y-PN QKSTGIFAEFLKLIVGNQADFKKHF--NLEDK-T---PLQ-FAKDSYDEDLEN 278
WP_001040095    213 LTDK-ISKSAKKDRILAR-Y-PN QKSTGIFAEFLKLIVGNQADFKKHF--NLEDK-T---PLQ-FAKDSYDEDLEN 278
WP_001040096    213 LTDK-ISKSAKKDRILAR-Y-PN QKSTGIFAEFLKLIVGNQADFKKHF--NLEDK-T---PLQ-FAKDSYDEDLEN 278
WP_001040097    213 LTDK-ISKSAKKDRILAR-Y-PN QKSTGIFAEFLKLIVGNQADFKKHF--NLEDK-T---PLQ-FAKDSYDEDLEN 278
WP_001040098    213 LTDK-ISKSAKKDRILAR-Y-PN QKSTGIFAEFLKLIVGNQADFKKHF--NLEDK-T---PLQ-FAKDSYDEDLEN 278
WP_001040099    213 LTDK-ISKSAKKDRILAR-Y-PN QKSTGIFAEFLKLIVGNQADFKKYF--NLEDK-T---PLQ-FAKDSYDEDLEN 278
WP_001040100    213 LTDK-ISKSAKKDRILAR-Y-PN QKSTGIFAEFLKLIVGNQADFKKYF--NLEDK-T---PLQ-FAKDSYDEDLEN 278
WP_001040104    213 LTDK-ISKSAKKDRILAR-Y-PN QKSTGIFAEFLKLIVGNQADFKKYF--NLEDK-T---PLQ-FAKDSYDEDLEN 278
WP_001040105    213 LTDK-ISKSAKKDRILAR-Y-PN QKSTGIFAEFLKLIVGNQADFKKYF--NLEDK-T---PLQ-FAKDSYDEDLEN 278
WP_001040106    213 LTDK-ISKSAKKDRILAR-Y-PN QKSTGIFAEFLKLIVGNQADFKKHF--NLEDK-T---PLQ-FAKDSYDEDLEN 278
WP_001040107    213 LTDK-ISKSAKKDRILAR-Y-PN QKSTGIFAEFLKLIVGNQADFKKHF--NLEDK-T---PLQ-FAKDSYDEDLEN 278
WP_001040108    213 LTDK-ISKSAKKDRILAR-Y-PN QKSTGIFAEFLKLIVGNQADFKKHF--NLEDK-T---PLQ-FAKDSYDEDLEN 278
WP_001040109    213 LTDK-ISKSAKKDRILAR-Y-PN QKSTGIFAEFLKLIVGNQADFKKHF--NLEDK-T---PLQ-FAKDSYDEDLEN 278
```

| ID | | | | | |
|---|---|---|---|---|---|
| WP_001040110 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_015058523 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_017643650 | 213 | LTDK-ISKSAKKDRILAR-Y-PN | QKSTGIFAEFLKLIVGNQADFKKHF--NLEDK-T---PLQ-FAKDSYDEDLEN | 278 |
| WP_017647151 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_017648376 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_017649527 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_017771611 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_017771984 | 213 | LTDK-ISKSAKKDRILAQ-Y-PN | QKSTGIFAEFLKLIVGNQADFKKYF--NLEDK-T---PLQ-FAKDSYDEDLEN | 278 |
| CFQ25032 | 213 | LTDK-ISKSAKKDRILAQ-Y-PN | QKSTGIFAEFLKLIVGNQADFKKYF--NLEDK-T---PLQ-FAKDSYDEDLEN | 278 |
| CFV16040 | 213 | LTDK-ISKSAKKDRILAQ-Y-PN | QKSTGIFAEFLKLIVGNQADFKKYF--NLEDK-T---PLQ-FAKDSYDEDLEN | 278 |
| KLJ37842 | 213 | LTDK-ISKSAKKDRILAR-Y-PN | QKSTGIFAEFLKLIVGNQADFKKHF--NLEDK-T---PLQ-FAKDSYDEDLEN | 278 |
| KLJ72361 | 213 | LTDK-ISKSAKKDRILAQ-Y-PN | QKSTGIFAEFLKLIVGNQADFKKHF--NLEDK-T---PLQ-FAKDSYDEDLEN | 278 |
| KLL20707 | 213 | LTDK-ISKSAKKDRILAQ-Y-PN | QKSTGIFAEFLKLIVGNQADFKKHF--NLEDK-T---PLQ-FAKDSYDEDLEN | 278 |
| KLL42645 | 213 | LTDK-ISKSAKKDRILAQ-Y-PN | QKSTGIFAEFLKLIVGNQADFKKYF--NLEDK-T---PLQ-FAKDSYDEDLEN | 278 |
| WP_047207273 | 213 | LTDK-ISKSAKKDRILAR-Y-PN | QKSTGIFAEFLKLIVGNQADFKKYF--NLEDK-T---PLQ-FAKDSYDEDLEN | 278 |
| WP_047209694 | 213 | LTDK-ISKSAKKDRILAR-Y-PN | QKSTGIFAEFLKLIVGNQADFKKYF--NLEDK-T---PLQ-FAKDSYDEDLEN | 278 |
| WP_050198062 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_050201642 | 213 | LTDK-ISKSAKKDRILAQ-Y-PN | QKSTGIFAEFLKLIVGNQADFKKHF--NLEDK-T---PLQ-FAKDSYDEDLEN | 278 |
| WP_050204027 | 213 | LTDK-ISKSAKKDRILAQ-Y-PN | QKSTGIFAEFLKLIVGNQADFKKYF--NLEDK-T---PLQ-FAKDSYDEDLEN | 278 |
| WP_050881965 | 213 | LTDK-ISKSAKKDRILAQ-Y-PN | QKSTGIFAEFLKLIVGNQADFKKYF--NLEDK-T---PLQ-FAKDSYDEDLEN | 278 |
| WP_050886065 | 213 | LTDK-ISKSAKKDRILAQ-Y-PN | QKSTGIFAEFLKLIVGNQADFKKHF--NLEDK-T---PLQ-FAKDSYDEDLEN | 278 |
| AHN30376 | 213 | LTDK-ISKSAKKDRILAQ-Y-PN | QKSTGIFAEFLKLIVGNQADFKKHF--NLEDK-T---PLQ-FAKDSYDEDLEN | 278 |
| EA078426 | 213 | LTDK-ISKSAKKDRILAQ-Y-PD | QKSTGIFAEFLKLIVGNQADFKKHF--NLEDK-T---PLQ-FAKDSYDEDLEN | 278 |
| CCW42055 | 213 | LTEK-VSKSRRLENLIAH-Y-PA | EKKNTLFGNLIALFLGLQPNFKTNF--QLSED-A---KLQ-FSKDTYEDLEG | 278 |
| WP_003021502 | 212 | LTEK-VSKSSRLENLIAH-Y-PT | EKKNTLFGNLIALSLGLQPNFKTNF--QLSED-A---KLQ-FSKDTYEEDLEE | 277 |
| WP_037593752 | 213 | LTEK-VSKSRRLENLVEC-Y-PT | EKKNTLFGNLIALSLGLQPNFKTNF--QLSED-A---KLQ-FSKDTYEEDLEG | 278 |
| WP_049516684 | 212 | LTEK-VSKSRRLENLIAH-Y-PT | EKKNTLFGNLIALSLGLQPNFKTNF--QLSED-A---KLQ-FSKDTYEEDLEE | 277 |
| GAD46167 | 213 | LTEK-ISKSRRLENLINN-Y-PK | EKKNTLFGNLIALALGLQPNFKTNF--KLSED-A---KLQ-FSKDTYEEDLEE | 278 |
| WP_018363470 | 212 | LTEK-LSKSKRLEKLIAV-F-PN | EKKNGLFGNLIALALGLTPNFKSNF--DLTED-A---KLQ-LSKDTYDDDLDE | 277 |
| WP_003043819 | 212 | LSAR-LSKSKRLISL-Y-PT | EKKNGLFGNLIALSLDLHPNFKTNF--QLSED-A---KLQ-FSKDTYEEDLEG | 277 |
| WP_062669658 | 212 | LTEK-VSKSSRLENLIAH-Y-PT | EKKNTLFGNLIALSLGLQPNFKTNF--QLSED-A---KLQ-FSKDTYEEDLEE | 277 |
| WP_048800889 | 212 | LTEK-VSKSRRLENLVKC-Y-PT | EKKNTLFGNLIALSLGLQPNFKTNF--DLAED-A---KLQ-FSKDTYDDDLDN | 277 |
| WP_012767106 | 212 | LSAR-LSKSRRLENLIAQ-L-PG | EKRNGLFGNLIALSLGLTPNFKSNF--DLAED-A---KLQ-LSKDTYDDDLDN | 277 |
| WP_014612333 | 212 | LSAR-LSKSRRLENLIAQ-Y-PT | EKKNGLFGNLIALSLGLTPNFKSNF--DLAED-A---KLQ-FSKDTYDDDLDN | 277 |
| WP_015017095 | 212 | LSAR-LSKSRRLENLIAQ-L-PG | EKRNGLFGNLIALSLGLTPNFKSNF--DLAED-A---KLQ-LSKDTYDDDLDN | 277 |
| WP_015057649 | 212 | LSAR-LSKSRRLENLIAQ-L-PG | EKRNGLFGNLIALSLGLTPNFKSNF--DLAED-A---KLQ-LSKDTYDDDLDN | 277 |
| WP_048327215 | 212 | LSAR-LSKSRRLENLIAQ-Y-PT | EKRNGLFGNLIALSLGLTPNFKSNF--DLAED-A---KLQ-FSKDTYDDDLDN | 278 |
| WP_049519324 | 212 | LSAR-LSKSRRLENLIAQ-L-PG | EKRNGLFGNLIALSLGLTPNFKSNF--DLAED-A---KLQ-LSKDTYDDDLDN | 277 |
| WP_012515931 | 212 | LSAA-LSKSKRLENLISL-I-PG | QKKTGIFGNLIALSLGLTPNFKANF--GLSKD-V---KLQ-LAKDTYADDLDS | 277 |
| WP_021320964 | 212 | LSAA-LSKSKRLENLISL-I-PG | QKKTGIFGNLIALSLGLTPNFKANF--GLSKD-V---KLQ-LAKDTYADDLDS | 277 |
| WP_037581760 | 212 | LSAA-LSKSRRLENLISL-I-PG | QKKTGIFGNLIALSLGLTPNFKANP--GLSKD-V---KLQ-LAKDTYADDLDS | 277 |
| WP_004232481 | 213 | LTEK-ISKSRRLENLIIKQ-Y-PT | EKKNTLFGNLIVALALGLQPNFKTNF--KLSED-A---KLQ-FSKDTYDEDLEE | 278 |
| WP_009854540 | 213 | LTEK-FSKSRRLENLIKH-Y-PT | EKKNTLFGNLIALGLQPNFKTSF--KLSED-A---KLQ-FSKDTYEEDLEE | 278 |
| WP_012962174 | 213 | LTEK-LSKSRRLENLIKY-Y-PT | EKKNTLFGNLIALGLQPNFKTNF--KLSED-A---KLQ-FSKDTYEEDLEE | 278 |
| WP_039695303 | 213 | LTEK-LSKSRRLENLIKY-Y-PT | EKKNTLFGNLIALGLQPNFKTNF--KLSED-A---KLQ-FSKDTYEEDLEE | 278 |
| WP_014334983 | 213 | LTEK-ISKSRRLENLIKQ-Y-PT | EKKNTLFGNLIALALGLQPNFKTNF--KLSED-A---KLQ-FSKDTYEEDLEE | 278 |
| WP_003099269 | 212 | LTSK-TSKSRRLENLIAE-I-PN | QKRNMLFGNLVSLALGLTPNFKTNF--ELLED-A---KLQ-ISKDSYEEDLDN | 277 |
| AHY15608 | 212 | LTSK-TSKSRRLENLIAE-I-PN | QKRNMLFGNLVSLALGLTPNFKTNF--ELLED-A---KLQ-ISKDSYEEDLDN | 277 |
| AHY17476 | 212 | LTSK-TSKSRRLENLIAE-I-PN | QKRNMLFGNLVSLALGLTPNFKTNF--ELLED-A---KLQ-ISKDSYEEDLDN | 277 |
| ESR09100 | | | | |
| AGM98575 | 212 | LTSK-TSKSRRLENLIAE-I-PN | QKRNMLFGNLVSLALGLTPNFKTNF--ELLED-A---KLQ-ISKDSYEEDLDN | 277 |
| ALF27331 | 210 | LTSK-ISKSAKKDRVLKL-F-PN | EKSNGRFAEFLKLIVGNQADFKKHF--ELEEK-A---PLQ-FSKDTYEEELEV | 277 |
| WP_018372492 | 210 | FTEN-SSKAKRVETILGL-F-PD | ETAAGNLDKFKLMLGNQADFKKVF--DLEEK----A---ITLQ-FSKDSYEEDLEL | 275 |

| | | | | |
|---|---|---|---|---|
| WP_045618028 | 213 | FTDK-ISKSAKRERVLKL-F-PD EKSTGLFSEFLKLIVGNQADFKKHF--DLEEK-A----PLQ--FSKDTYDEDLEN | 278 |
| WP_045635197 | 212 | FTDK-ISKSAKRERVLKL-F-PD EKSTGLFSEFLKLIVGNQADFKKHF--DLEDK-A----PLQ--FSKDTYDEDLEN | 277 |
| WP_002263549 | 212 | LTDK-ISKSAKDRVLKL-F-PN EKSNGRFAEFLKLIVGNQADFKKHP--ELEEK-A----PLQ--FSKDTYEEELEV | 277 |
| WP_002263887 | 212 | LTDK-ISKSAKDRVLKL-F-PN EKSNGRFAEFLKLIVGNQADFKKHP--ELEEK-A----PLQ--FSKDTYEEELEV | 277 |
| WP_002264920 | 212 | LTEK-ISKRRLEKLINN-Y-PK EKKNTLFRNLVALSLGLQPNFKTNF--KLSED-A----KLQ--FSKDTYEEDLEE | 277 |
| WP_002269043 | 212 | LTDK-ISKSAKDRVLKL-F-PN EKSNGRFAEFLKLIVGNQADFKKHP--ELEEK-A----PLQ--FSKDIYEEELEV | 277 |
| WP_002269448 | 212 | LTDK-ISKSAKDRVLKL-F-PN EKSNGRFAEFLKLIVGNQADFKKHP--ELEEK-A----PLQ--FSKDTYEEELEV | 277 |
| WP_002271977 | 212 | LTDK-ISKSAKDRVLKL-F-PN EKSNGRFAEFLKLIVGNQADFKKHP--ELEEK-A----PLQ--FSKDTYEEDLEE | 277 |
| WP_002272766 | 212 | LTDK-ISKSAKDRVLKL-F-PN EKSNGRFAEFLKLIVGNQADFKKHP--ELEEK-A----PLQ--FSKDTYEEELEV | 277 |
| WP_002273241 | 212 | LTDK-ISKSAKDRVLKL-F-PN EKSNGRFAEFLKLIVGNQADFKKHP--ELEEK-A----PLQ--FSKDTYEEELEV | 277 |
| WP_002275430 | 212 | LTDK-ISKSAKDRVLKL-F-PN EKSNGRFAEFLKLIVGNQADFKKHP--ELEEK-A----PLQ--FSKDTYEEELEV | 277 |
| WP_002276448 | 212 | LTDK-ISKSAKDRVLKL-F-PN EKSNGRFAEFLKLIVGNQADFKKHP--ELEEK-A----PLQ--FSKDTYEEELEV | 277 |
| WP_002277050 | 212 | LTEK-ISKSRRLEKLINN-Y-PK EKKNTLFGNLIALSLGLQPNFKTNF--KLSED-A----KLQ--FSKDTYEEDLEE | 277 |
| WP_002277364 | 212 | LTDK-ISKSAKDRVLKL-F-PN EKSNGRFAEFLKLIVGNQADFKKHP--ELEEK-A----PLQ--FSKDTYEEELEV | 277 |
| WP_002279025 | 212 | LTDK-ISKSAKDRVLKL-F-PN EKSNGRFAEFLKLIVGNQADFKKHP--ELEEK-A----PLQ--FSKDTYEEELEV | 277 |
| WP_002279859 | 212 | LTEK-ISKSRRLEKLINN-Y-PK EKKNTLFGNLIALSLGLQPNFKTNF--KLSED-A----KLQ--FSKDTYEEDLEE | 277 |
| WP_002280230 | 212 | LTDK-ISKSAKDRVLKL-F-PN EKSNGRFAEFLKLIVGNQADFKKHP--ELEEK-A----PLQ--FSKDTYEEELEV | 277 |
| WP_002281696 | 212 | LTDK-ISKSAKDRVLKL-F-PN EKSNGRFAEFLKLIVGNQADFKKHP--ELEEK-A----PLQ--FSKDTYEEELEV | 277 |
| WP_002282247 | 212 | LTEK-ISKSRRLEKLINN-Y-PK EKKNTLFGNLIALSLGLQPNFKTNF--KLSED-A----KLQ--FSKDTYEEDLEG | 277 |
| WP_002282906 | 212 | LTDK-ISKSAKDRVLKL-F-PN EKSNGRFAEFLKLIVGNQADFKKHP--ELEEK-A----PLQ--FSKDTYEEELEV | 277 |
| WP_002283846 | 212 | LTDK-ISKSAKDRVLKL-F-PN EKSNGRFAEFLKLIVGNQADFKKHP--ELEEK-A----PLQ--FSKDTYEEELEV | 277 |
| WP_002287255 | 212 | LTDK-ISKSAKDRVLKL-F-PN EKSNGRFAEFLKLIVGNQADFKKHP--ELEEK-A----PLQ--FSKDTYEEELEV | 277 |
| WP_002288990 | 212 | LTDK-ISKSAKDRVLKL-F-PN EKSNGRFAEFLKLIVGNQADFKKHP--ELEEK-A----PLQ--FSKDTYEEELEV | 277 |
| WP_002289641 | 212 | LTDK-ISKSAKDRVLKL-F-PN EKSNGCFAEFLKLIVGNQADFKKHP--ELEEK-A----PLQ--FSKDIYEEELEV | 277 |
| WP_002290427 | 212 | LTDK-ISKSAKDRVLKL-F-PN EKSNGRFAEFLKLIVGNQADFKKHP--ELEEK-A----PLQ--FSKDIYEEELEV | 277 |
| WP_002295753 | 212 | LTDK-ISKSAKDRVLKL-F-PN EKSNGRFAEFLKLIVGNQADFKKHP--ELEEK-A----PLQ--FSKDIYEEELEV | 277 |
| WP_002296423 | 212 | LTEK-VSKSRRLENLVEC-Y-PT EKKNTLFGNLIALSLGLQPNFKTNF--QLSED-A----PLQ--FSKDTYEEDLEG | 277 |
| WP_002304487 | 212 | LTDK-ISKSAKDRVLKL-F-PN EKSNGRFAEFLKLIVGNQADFKKHP--ELEEK-A----PLQ--FSKDTYEEELEV | 277 |
| WP_002305844 | 212 | LTDK-ISKSAKDRVLKL-F-PN EKSNGRFAEFLKLIVGNQADFKKHP--ELEEK-A----PLQ--LSKDTYEEELEV | 277 |
| WP_002307203 | 212 | LTDK-ISKSAKDRVLKL-F-PN EKSNGRFAEFLKLIVGNQADFKKHP--ELEEK-A----PLQ--FSKDTYEEELEV | 277 |
| WP_002310390 | 212 | LTEK-ISKSRRLEKLINN-Y-PK EKKNTLFGNLIALSLGLQPNFKTNF--KLSED-A----KLQ--FSKDTYEEDLEE | 277 |
| WP_002352408 | 212 | LTDK-ISKSAKDRVLKL-F-PN EKSNGRFAEFLKLIVGNQADFKKHP--ELEEK-A----PLQ--FSKDTYEEELEV | 277 |
| WP_012997688 | 212 | LTDK-ISKSAKDRVLKL-F-PN EKSNGRFAEFLKLIVGNQADFKKHP--ELEEK-A----PLQ--FSKDTYEEELEV | 277 |
| WP_014677909 | 212 | LTDK-ISKSAKDRVLKL-F-PN EKSNGRFAEFLKLIVGNQADFKKHP--ELEEK-A----PLQ--FSKDTYEEELEV | 277 |
| WP_019312892 | 212 | LTDK-ISKSAKDRVLKL-F-PN EKSNGRFAEFLKLIVGNQADFKKHP--ELEEK-A----PLQ--FSKDTYEEELEV | 277 |
| WP_019313659 | 212 | LTEK-ISKSRRLEKLINN-Y-PK EKKNTLFGNLIIGNQADFKKHP--ELEEK-A----PLQ--FSKDTYEEELEV | 277 |
| WP_019314093 | 212 | LTDK-ISKSAKDRVLKL-F-PN EKSNGRFAEFLKLIVGNQADFKKHP--KLSED-A----KLQ--LSKDTYEEELEV | 277 |
| WP_019315370 | 212 | LTDK-ISKSAKDRVLKL-F-PN EKSNGRFAEFLKLIVGNQADFKKHP--ELEEK-A----PLQ--FSKDTYEEELEV | 277 |
| WP_019803776 | 212 | LTDK-ISKSAKDRVLKL-F-PN EKSNGRFAEFLKLIVGNQADFKKHP--ELEEK-V----PLQ--FSKDIYEEELEV | 277 |
| WP_019805234 | 212 | LTDK-ISKSAKDRVLKL-F-PN EKSNGRFAEFLKLIVGNQADFKKHP--ELEEK-A----PLQ--FSKDTYEEELEV | 277 |
| WP_024783594 | 212 | LTDK-ISKSAKDRVLKL-F-PN EKSNGRFAEFLKLIVGNQADFKKHP--ELEEK-A----PLQ--FSKDTYEEELEV | 277 |
| WP_024784288 | 212 | LTEK-ISKSRRLEKLINN-Y-PK EKKNTLFGNLIALSLGLQPNFKTNF--KLSED-A----KLQ--FSKDTYEEDLEE | 277 |
| WP_024784666 | 212 | LTDK-ISKSAKDRVLKL-F-PN EKSNGRFAEFLKLIVGNQADFKKHP--ELEEK-A----PLQ--FSKDTYEEELEV | 277 |
| WP_024784894 | 212 | LTDK-ISKSAKDRVLKL-F-PN EKSNGRFAEFLKLIVGNQADFKKHP--KLSED-A----KLQ--FSKDTYEEDLEE | 277 |
| WP_024786433 | 212 | LTEK-ISKSRRLEKLINN-Y-PK EKKNTLFGNLIALSLGLQPNFKTNF--ELEEK-A----PLQ--FSKDTYEEELEV | 277 |
| WP_049473442 | 212 | LTDK-ISKSAKDRVLKL-F-PN EKSNGRFAEFLKLIVGNQADFKKHP--ELEEK-A----PLQ--FSKDTYEEELEV | 277 |
| WP_049474547 | 212 | LTDK-ISKSAKDRVLKL-F-PN EKSNGRFAEFLKLIVGNQADFKKHP--ELEEK-A----PLQ--FSKDTYEEELEV | 277 |
| EMC03581 | 205 | FTDK-ISKSAKRERVLKL-F-PD EKSTGLFSEFLKLIVGNQADFKKHF--ELEEK-A----PLQ--FSRDTYDEDLEN | 270 |
| WP_000428612 | 213 | FTDK-ISKSAKRERVLKL-F-PD EKSTGLFSEFLKLIVGNQADFKKHF--DLEEK-A----PLQ--FSKDTYDEDLEN | 278 |
| WP_000428613 | 212 | FTDK-ISKSAKDRVLKL-F-PD EKSTGLFSEFLKLIVGNQADFKKHF--DIGEK-A----PLQ--FSKDTYDEDLEN | 277 |
| WP_049523028 | 181 | LTEK-MSKSRRLENLIAK-I-PN QKKNLFGNLISLSLGLTPNFKANF--ELSED-A----KLQ--ISKESFEEDLDN | 246 |
| WP_003107102 | 214 | LTEK-ISKTRRLENLISN-I-PG QKKNGLFGNLIALSLGLTPNFKSHF--NLPED-A----KLQ--LAKDTYDEELNN | 279 |
| WP_054729288 | | | |

| ID | Pos | Sequence | End |
|---|---|---|---|
| WP_049531101 | 213 | FTDK-ISKSTKRERVLKL-F-PD QKSTGLFSEFLKLIVGNQADFKKHF--DLEEK-A---PLQ-FSKDTYDEDLEN | 278 |
| WP_049538452 | 213 | FSDK-ISKSAKRERVLKL-F-PD EKSTGLFSEFLKLIVGNQADFKKHF--DLEEK-A---PLQ-FSKDTYDEDLEN | 278 |
| WP_049549711 | 213 | FTDK-ISKSAKRERVLKL-F-PD EKSTGLFSEFLKLIVGNQADFKKHF--DLGEK-A---PLQ-FSKDTYDEDLEN | 278 |
| WP_007896501 | 214 | LTAK-TSKSKRLESLISE-F-PG QKKNGLFGNLLALALGLRPNFKSNF--GLsED-A---KLQ-ITKDTYEEELDN | 279 |
| EFR44625 | 166 | LTAK-TSKSKRLESLISE-F-PG QKKNGLFGNLLALALGLRPNFKSNF--GLsED-A---KLQ-ITKDTYEEELDN | 231 |
| WP_002897477 | 212 | FTDK-ISKSAKRERVLKL-F-PD EKSTGLFSEFLKLIVGNQADFKKHF--DLEEK-A---PLQ-FSKDTYDEELEN | 277 |
| WP_002906454 | 212 | FTDK-ISKSTKRERVLKL-F-SD EKSTGLFSEFLKLIVGNQADFKKHF--DLEEK-A---PLQ-FSKDTYDEELEN | 277 |
| WP_009729476 | 213 | FTDK-ISKSAKRERVLKL-F-PD EKSTGLFSEFLKLIVGNQADFKKHF--DLEEK-A---PLQ-FSRDTYDEDLEN | 278 |
| CQR24647 | 212 | ITAK-ISKSRKVEAVLEQ-F-PD QKKNSFFGNMVSLVFGLMPNEKSNF--ELDED-A---KLQ-FSRDSYDEDLEN | 277 |
| WP_000066813 | 213 | FTDK-ISKSTKRERVLKL-F-PD EKSTGLFSEFLKLIVGNQADFKKHF--DLEEK-A---PLQ-FSKDTYDEDLEN | 278 |
| WP_009754323 | 213 | FTGK-ISKSVKREHVLKL-F-PD EKSTGLFSEFLKLIVGNQADFKKHF--DLGEK-A---SLQ-FSKDTYDEDLEN | 278 |
| WP_044674937 | 212 | LVEK-VSKSRRLENILHY-F-PN EKKNGLFGNLLALALGLQPNEKTNF--ELAED-A---KIQ-FSKETYEEDLEE | 277 |
| WP_044676715 | 212 | LVEK-VSKSRRLENILHY-F-PN EKKNGLFGNFLTLALGLQPNEKTNF--ELAED-A---KIQ-FSKETYEEDLEE | 277 |
| WP_044680361 | 212 | LVEK-VSKSRRLENILHY-F-PN EKKNGLFGNFLALALGLQPNEKTNF--ELAED-A---KIQ-FSKETYEEDLEE | 277 |
| WP_044681799 | 212 | LVEK-VSKSRRLENILHY-F-PN EKKNGLFGNFLALALGLQPNEKTNF--ELAED-A---KIQ-FSKETYEEDLEE | 277 |
| WP_049533112 | 212 | LTEK-VSKSRRLENLIAH-Y-PA EKKNTLFGNLIALSLGLQPNEKTNF--QLSED-A---KLQ-FSKDTYEEDLEG | 277 |
| WP_029090905 | 172 | LLDRmMNRSSKVKFLIEL--TG KQDKPLLKELFNLIVGLKAKPASIFe---QENIAtiveTM-nMSTEQVQLDLLt | 243 |
| WP_006506696 | 211 | LKKP-LSKKAKVDEVMTL-IaPE KDYKSAFKELVTGIAGNKMNVTKMI1cEPIKQ-Gds-EIK1kFSDSNYDDQFSE | 283 |
| AIT42264 | 212 | LSAR-LSKSRRLENLIAQ-L-PG EKKNGLFGNLIALSLGLITPNEKSNF--DIAED-A---KLQ-LSKDTYDDDLDN | 277 |
| WP_034440723 | 218 | FKQD-ISRSKKLDQAIAL-F-QG -KRQSLFGIFLTLIVGNKANFQKIF--NLEDD----iKLD-lKEEDYDENLEE | 283 |
| AKQ21048 | 212 | LSAR-LSKSRRLENLIAQ-L-PG EKKNGLFGNLIALSLGLITPNEKSNF--DIAED-A---KLQ-LSKDTYDDDLDN | 277 |
| WP_004636532 | 211 | LSSK-QSRSRKHEQIMAL-F-PN ENKLGNFGRFMMLIVGNTSNFKPVF--DLDDE-Y---KLK-LsDETYEEDLDT | 276 |
| WP_002378009 | 218 | LTEK-ASRTKKSSEKVLQQ-F-PQ EKANGLFGQFLKLMVGNKADFKKVF--GLEEE-A---KI--tYASESYEEDLEG | 283 |
| WP_002407324 | 218 | LTEK-ASRTKKSSEKVLQQ-F-PQ EKANGLFGQFLKLMVGNKADFKKVF--GLEEE-A---KI--tYASESYEEDLEG | 283 |
| WP_002413717 | 169 | LTEK-ASRTKKSSEKVLQQ-F-PQ EKANGLFGQFLKLMVGNKADFKKVF--GLEEE-A---KI--tYASESYEEDLEG | 234 |
| WP_010775580 | 1 | -------------------------- --------------------MDEE-A---GL--LSKESYEEELES | 20 |
| EM575795 | 218 | LTEK-ASRTKKSSEKVLQQ-F-PQ EKANGLFGQFLKLMVGNKADFKKVF--GLEEE-A---KI--tYASESYEEDLEG | 283 |
| WP_002373311 | 218 | LTEK-ASRTKKSSEKVLQQ-F-PQ EKANGLFGQFLKLMVGNKADFKKVF--GLEEE-A---KIKitYASESYEEDLEG | 285 |
| WP_010818269 | 218 | LTEK-ASRTKKSSEKVLQQ-F-PQ EKANGLFGQFLKLMVGNKADFKKVF--GLEEE-A---KI--tYASESYEEDLEG | 283 |
| WP_010824395 | 218 | LTEK-ASRTKKSSEKVLQQ-F-PQ EKANGLFGQFLKLMVGNKADFKKVF--GLEEE-A---KI--tYASESYEEDLEG | 283 |
| WP_016622645 | 218 | LTEK-ASRTKKSSEKVLQQ-F-PQ EKANGLFGQFLKLMVGNKADFKKVF--GLEEE-A---KI--tYASESYEEDLEG | 283 |
| WP_033624816 | 218 | LTEK-ASRTKKSSEKVLQQ-F-PQ EKANGLFGQFLKLMVGNKADFKKVF--GLEEE-A---KI--tYASESYEEDLEG | 283 |
| WP_033625576 | 218 | LTEK-ASRTKKSSEKVLQQ-F-PQ EKANGLFGQFLKLMVGNKADFKKVF--GLEEE-A---KI--tYASESYEEDLEG | 283 |
| WP_033789179 | 218 | LTEK-ASRTKKSSEKVLQQ-F-PQ EKANGLFGQFLKLMVGNKADFKKVF--GLEEE-A---KI--tYASESYEEDLEG | 283 |
| WP_002310644 | 217 | FTEK-MSKTKKAETLLKY-F-PH EKSNGYLSQFIKLMVGNKQQGNFKNVF--GL-EE-A---KLQ-FSKETYEEDLEE | 281 |
| WP_002312694 | 217 | FTEK-MSKTKKAETLLKY-F-PH EKSNGYLSQFIKLMVGNKQQGNFKNVF--GL-EEeA---KLQ-FSKETYEEDLEE | 282 |
| WP_002314015 | 217 | FTEK-MSKTKKAETLLKY-F-PH EKSNGYLSQFIKLMVGNKQQGNFKNVF--GL-EEeA---KLQ-FSKETYEEDLEE | 282 |
| WP_002320716 | 217 | FTEK-MSKTKKAETLLKY-F-PH EKSNGYLSQFIKLMVGNKQQGNFKNVF--GL-EE-A---KLQ-FSKETYEEDLEE | 281 |
| WP_002330729 | 217 | FTEK-MSKTKKAETLLKY-F-PH EKSNGYLSQFIKLMVGNKQQGNFKNVF--GL-EEeA---KLQ-FSKETYEEDLEE | 282 |
| WP_002335161 | 217 | FTEK-MSKTKKAETLLKY-F-PH EKSNGYLSQFIKLMVGNKQQGNFKNVF--GL-EEeA---KLQ-FSKETYEEDLEE | 282 |
| WP_002345439 | 217 | FTEK-MSKTKKAETLLKY-F-PH EKSNGYLSQFIKLMVGNKQQGNFKNVF--GL-EEeA---KLQ-FSKETYEEDLEE | 282 |
| WP_034867970 | 210 | LTDK-LSKTKKVEEILKY-Y-PT EKINSFFAQCLKLIVGNQANFKRIF--DLEAE-V---KLQ-FSKETYEEDLES | 275 |
| WP_047937432 | 217 | FTEK-MSKTKKAETLLKY-F-PT EKSNGYLSQFIKLMVGNQANFKNVF--GL-EEeA---KLQ-FSKETYEEDLEE | 282 |
| WP_010720994 | 210 | LTDK-LSKTKKVEEILKY-Y-PT EKINSFFAQCLKLIVGNQANFKRIF--DLEAE-V---KLQ-FSKETYEEDLES | 275 |
| WP_010737004 | 210 | LTDK-LSKTKKVEEILKY-Y-PT EKINSFFAQCLKLIVGNQANFKRIF--DLEAE-V---KLQ-FSKETYEEDLES | 275 |
| WP_034700478 | 210 | LTDK-LSKTKKVEEILKY-Y-PT EKINSFFAQCLKLIVGNQANFKRIF--DLEAE-V---KLQ-FSKETYEEDLES | 275 |
| WP_037200903 | 215 | LTQQ-LSKSERADNVLKL-F-PD EKGTGIFAQFIKLIVGNQQNFKNVF--QLEAD----qKLQ-LsTDDYEENIEN | 280 |
| WP_023519017 | 210 | LTER-LSKAKRVEKVLAY-Y-PS EKSTGNFAQFLKLIVGNQANFKKTF--DLEEE-M---KLN-FTRDCYEDLNE | 275 |
| WP_010770040 | 213 | FSEK-VSRARKVEAILSV-Y-SE EKRNGTFDQFLKMIVGNQNFKKTF--DLEED-G---IIQ-IPKEEYEEELET | 278 |
| WP_048604708 | 209 | FADK-VSRAKKAEGVLAL-F-PD EKSTGLFSEFLKLIVGNQADFKKVF--ELEED-A---KLQ-FSKEEYDESLEA | 274 |
| WP_010750235 | 210 | LTDK-LSKSKKVEKILQY-Y-PK EKTTGCLAQFIKLIVGNQNFKQAF--HLDEE-V---KIQ-ISKETYEEDLEK | 275 |

-continued

```
AII16583         251 LSAR-LSKSRRLENLIAQ-L-PG EKKNGLFGNLIALSLGLTPNEKSNF--DLAED-A---KLQ-LSKDTYDDDLDN 316
WP_029073316     216 LKEP-LSKKHKADKAFAL-FdTT KDNKAAYKELCAALAGNKFNVTKMLkeAELHD-EdekDIsfkFSDATFDDAFVE 289
WP_031589969     216 LKEP-LSKKHKAEKAFAL-FdTT KDNKAAYKELCAALAGNKFNVTKMLkeAELHD-EdekDIsfkFSDATFDDAFVE 289
KDA45870         210 FKDNtFSKTKKSEELLKL---SG -KKNQLAHQLFKMVGNMGSFKKVL--GTDEE---hKLsS-FGKDTYEDDLND 275
WP_039099354     207 LLDNhQSASNRQRQALLLiYtPS KQNKAIATELLKALLKAILGLKAKFNVLT--GlEAEgVKtwTLT-FNAENFDEEMVK 285
AKP02966         209 LIGR-GNATQKSSNILNN-F--T KETKKLLKEVINLLGNVAHLNTIFKtsLTKDeE--KLsS-FSGKDIESKLDD 278
WP_010991369     218 LVEK-VTRKEKLERILKL-Y-PG EKSAGMFAQFISLIVGSKGNFQKPF--DLIEK-S---DIE-CAKDSYEEDLES 283
WP_033838504     218 LVEK-VTRKEKLERILKL-Y-PG EKSAGMFAQFISLIVGSKGNFQKPF--DLIEK-S---DIE-CAKDSYEEDLES 283
EHN60060         221 LVEK-VTRKEKLERILKL-Y-PG EKSAGMFAQFISLIVGSKGNFQKPF--DLIEK-S---DIE-CAKDSYEEDLES 286
EFR89594           1 -----------LKL-Y-PG EKSTGMFAQFISLIVGSKGNFQKVF--DLIEK-S---EIE-CAKDTYEEDLES 52
WP_038409211     218 LSEK-LTRREKLDKILKL-Y-TG EKSTGMFARFINLIGSKGDFKKVF--DLDEK-A---EIE-CAKDTYEEDLEA 283
EFR95520           1 ------------------------------------------------------------------
WP_003723650     218 LAGK-FTRREKFERILQL-Y-PG EKSTGMFAQFISLIVGSKGNFQKVF--DLIEK-T---DIE-CAKDSYEEDLET 283
WP_003727705     218 LAGK-FTRREKFERILRL-Y-PG EKSTGMFAQFISLIVGNKGNFQKVF--NLVEK-T---DIE-CAKDSYEEDLEA 283
WP_003730785     218 LAGK-FTRREKFERILRL-Y-PG EKSTGMFAQFISLIVGNKGNFQKVF--NLVEK-T---DIE-CAKDSYEEDLEA 283
WP_003733029     218 LAEK-FTRKDKLDKILSL-Y-PG EKTTGVFAQFVNIIVGSTGKEKKHF--NLHEK-K---DIN-CAEDTYDTDLES 283
WP_003739838     218 LAGK-FTRREKFERILQL-Y-PG EKSTGMFAQFISLIVGSKGNFQKVF--DLIVEK-T---DIE-CAKDSYEEDLEA 283
WP_014601172     218 LAGK-FTRREKFERILQL-Y-PG EKSTGMFAQFISLIVGSKGNFQKVF--DLIEK-T---DIE-CAKDSYEEDLEA 283
WP_023548323     218 LAGK-FTRREKFERILQL-Y-PG EKSTGMFAQFISLIVGSKGNFQKVF--DLIEK-T---DIE-CAKDSYEEDLEA 283
WP_031665337     218 LAGK-FTRREKFERILQL-Y-PG EKSTGMFAQFISLIVGSKGNFQKVF--DLIEK-T---DIE-CAKDSYEEDLET 283
WP_031669209     218 LAEK-FTRKDKLDKILSL-Y-PG EKTTGVFAQFVNIIVGSTGKEKKHF--NLHEK-K---DIN-CAEDTYDTDLES 283
WP_033920898     218 LARK-FTRREKFERILQL-Y-PG EKSTGMFAQFISLIVGSKGNFQKVF--DLIEK-T---DIE-CAKDSYEEDLES 283
AKI42028         221 LARK-FTRREKFERILQL-Y-PG EKSTGMFAQFISLIVGSKGNFQKVF--DLIEK-T---DIE-CAKDSYEEDLEA 286
AKI50529         221 LARK-FTRREKFERILQL-Y-PG EKSTGMFAQFISLIVGSKGNFQKVF--DLIEK-T---DIE-CAKDSYEEDLET 286
EFR83390           1 ------------------------------------------------------------------
WP_046323366     218 FSEK-LTKREKLDKILNL-Y-PN EKSTDLFAQFISLIIGSKGNEKKPF--NLTEK-T---DIE-CAKDSYEEDLEV 283
AKE81011         228 LSAR-LSKSRRLENLIAQ-L-PG EKKNGLEGNLIALSLGLTPNEKSNF--DLAED-A---KLQ-LSKDTYDDDLDN 293
CU082355         279 LLGKIGDDYADLFTSAKNLYDAILLSGILTVDDNSTKAPLSASMIKRYVEHHEDLEKLKEFIKAN-KSELYHDIFKDKNK 357
WP_045635197     278 LLGQIGDDFTDLFVSAKKLYDAILLYDAILLSGILTVTDPSTKAPLSASMIKRYENHQNDLAALKQFIKNN-LPEKYDEVFSDQSK 356
AGZ01981         245 LSAR-LSKSRRLENLIAQ-L-PG EKKNGLEGNLIALSLGLTPNEKSNF--DLAED-A---KLQ-LSKDTYDDDLDN 310
AKA60242         212 LSAR-LSKSRRLENLIAQ-L-PG EKKNGLEGNLIALSLGLTPNEKSNF--DLAED-A---KLQ-LSKDTYDDDLDN 277
AKS40380         216 LSAR-LSKSRRLENLIAQ-L-PG EKKNGLEGNLIALSLGLTPNEKSNF--DLAED-A---KLQ-LSKDTYDDDLDN 281
4UN5_B           278 LLAQIGDQYADLFLAAKNLSDAILLSDILRVNTEITKAPLSASMIKRYDEHHQDLTLLKALVRQQ-LPEKYKEIFFDQSK 356
WP_010922251     279 LLGKIGDDYADLFTSAKNLYDAILLSGILTVDDNSTKAPLSASMIKRYVEHHEDLEKLKEFIKAN-KSELYHDIFKDKNK 357
WP_039695303     278 LLGQIGDDFTDLFVSAKKLYDAILLYDAILLSGILTVTDPSTKAPLSASMIKRYENHQNDLAALKQFIKNN-LPEKYDEVFSDQSK 356
WP_045635197     158 ---------------------------------------LERLKKDG-----EVR--- 168
5AXW_A             1 ------------------------------------LSASMIKRYDEHHQDLTLLKALVRQQ-LPEKYKEIFFDQSK 40
WP_009880683     278 LLAQIGDQYADLFLAAKNLSDAILLSDILRVNTEITKAPLSASMIKRYDEHHQDLTLLKALVRQQ-LPEKYKEIFFDQSK 356
WP_010922251     278 LLAQIGDQYADLFLAAKNLSDAILLSDILRVNTEITKAPLSASMIKRYDEHHQDLTLLKALVRQQ-LPEKYKEIFFDQSK 356
WP_011054416     278 LLAQIGDQYADLFLAAKNLSDAILLSDATLLSDILRVNSEITKAPLSASMIKRYDEHHQDLTLLKALVRQQ-LPEKYKEIFFDQSK 356
WP_011284745     278 LLAQIGDQYADLFLAAKNLSDAILLSDILRLNSEITKAPLSASMIKRYDEHHQDLTLLKALVRQQ-LPEKYKEIFFDQSK 356
WP_011285506     278 LLAQIGDQYADLFLAAKNLSDAILLSDILRVNSEITKAPLSASMIKRYDEHHQDLTLLKALVRQQ-LPEKYKEIFFDQSK 356
WP_011527619     278 LLAQIGDQYADLFLAAKNLSDAILLSDILRLNSEITKAPLSASMIKRYDEHHQDLTLLKALVRQQ-LPEKYKEIFFDQSK 356
WP_012560673     278 LLAQIGDQYADLFLAAKNLSDAILLSDILRVNSEITKAPLSASMIKRYDEHHQDLTLLKALVRQQ-LPEKYKEIFFDQSK 356
WP_014407541     278 LLAQIGDQYADLFLAAKNLSDAILLSDILRVNSEITKAPLSASMIKRYDEHHQDLTLLKALVRQQ-LPEKYKEIFFDQSK 356
WP_020905136     278 LLAQIGDQYADLFLAAKNLSDAILLSDILRLNSEITKAPLSASMIKRYDEHHQDLTLLKALVRQQ-LPEKYKEIFFDQSK 356
WP_023080005     278 LLAQIGDQYADLFLAAKNLSDAILLSDILRVNSEITKAPLSASMIKRYDEHHQDLTLLKALVRQQ-LPEKYKEIFFDQSK 356
WP_023610282     278 LLAQIGDQYADLFLAAKNLSDAILLSDILRVNSEITKASLSASMIKRYDEHHQDLTLLKALVRQQ-LPEKYKEIFFDQSK 356
WP_025125963     278 LLAQIGDQYADLFLAAKNLSDATLLSDILRVNSEITKAPLSASMIKRYDEHHQDLTLLKALVRQQ-LPEKYKEIFFDQSK 356
WP_030126706     278 LLAQIGDQYADLFLAAKNLSDATLLSDILRVNSEITKAPLSASMIKRYDEHHQDLTLLKALVRQQ-LPEKYKEIFFDQSK 356
WP_031488318     278 LLAQIGDQYADLFLAAKNLSDAILLSDILRVNSEITKAPLSASMIKRYDEHHQDLTLLKALVRQQ-LPEKYKEIFFDQSK 356
WP_032460140     278 LLAQIGDQYADLFLAAKNLSDAILLSDILRVNSEITKAPLSASMIKRYDEHHQDLTLLKALVRQQ-LPEKYKEIFFDQSK 356
WP_032461047     278 LLAQIGDQYADLFLAAKNLSDAILLSDILRVNTEITKAPLSASMIKRYDEHHQDLTLLKALVRQQ-LPEKYKEIFFDQSK 356
```

| | | | |
|---|---|---|---|
| WP_032462016 | 278 | LLAQIGDQYADLFLAAKNLSDAILLSDILRVNTEITKAPLSASMIKRYDEHHQDLTLLKALVRQQ-LPEKYKEIFFDQSK | 356 |
| WP_032462936 | 278 | LLAQIGDQYADLFLAAKNLSDAILLSDILRVNSEITKAPLSASMIKRYDEHHQDLTLLKALVRQQ-LPEKYKEIFFDQSK | 356 |
| WP_032464890 | 278 | LLAQIGDQYADLFLAAKNLSDAILLSDILRLNSEITKAPLSASMIKRYDEHHQDLTLLKALVRQQ-LPEKYKEIFFDQSK | 356 |
| WP_033888930 | 103 | LLAQIGDQYADLFLAAKNLSDAILLSDILRVNSEITKAPLSASMIKRYDEHHQDLTLLKALVRQQ-LPEKYKEIFFDQSK | 181 |
| WP_038431314 | 278 | LLAQIGDQYADLFLAAKNLSDATLLSDILRVNSEITKAPLSASMIKRYDEHHQDLTLLKALVRQQ-LPEKYKEIFFDQSK | 356 |
| WP_038432938 | 278 | LLAQIGDQYADLFLAAKNLSDAILLSDILRVNSEITKAPLSASMIKRYDEHHQDLTLLKALVRQQ-LPEKYKEIFFDQSK | 356 |
| WP_038434062 | 278 | LLAQIGDQYADLFLAAKNLSDAILLSDILRVNSEITKAPLSASMIKRYDEHHQDLTLLKALVRQQ-LPEKYKEIFFDQSK | 356 |
| BAQ51233 | 189 | LLAQIGDQYADLFLAAKNLSDAILLSDILRVNTEITKAPLSASMIKRYDEHHQDLTLLKALVRQQ-LPEKYKEIFFDQSK | 267 |
| KGE60162 | | ---------------------------------------------------------------------------- | |
| KGE60856 | | ---------------------------------------------------------------------------- | |
| WP_002989955 | 278 | LLAQIGDQYADLFLAAKNLSDAILLSDILRLNSEITKAPLSASMIKRYDEHHQDLTLLKALVRQQ-LPEKYKEIFFDQSK | 356 |
| WP_003030002 | 278 | LLGEIGDEYADLFSAAKNLYDAILLSGILLTVDDNSTKAPLSASMVKRYEEHQKDLKKLKDFIKVN-APDQYNAIFKDKNK | 356 |
| WP_003065552 | 281 | LLGKIGDDYADLFTSAKNLYDAILLSGILIVDDNSTKAPLSASMIKRYVEHQEDLEKLKEFIKAN-KSELYHDIFKDKNK | 359 |
| WP_001040076 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040078 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040080 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040081 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040083 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040085 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040087 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040088 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040089 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040090 | 279 | LLRQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040091 | 279 | LLGQIGDEFADLFSAAKKLYDSVLLSGILTVIDLSTKAPLSTKAPLSASMIQHYDEHREDLKQLKQFVKAS-LPEKYQEIFADSSK | 357 |
| WP_001040092 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040094 | 279 | LLGQIGDEFADLFSAAKKLYDSVLLSGILTVIDLSTKAPLSTKAPLSAVMIQRYDEHREDLKQLKQFVKAS-LPEKYQEIFADSSK | 357 |
| WP_001040095 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040096 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040097 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040098 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040099 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040100 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040104 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040105 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_001040106 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| WP_001040107 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| WP_001040108 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| WP_001040109 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| WP_001040110 | 279 | LLGQIGDEFADLFSVAKKLYDSVLLSGILTVIDLSTKAPLSTKAPLSASMIQRYDEHREDLKQLKQFVKAS-LPEKYQEIFADSSK | 357 |
| WP_015058523 | 279 | LLGQIGDEFADLFSVAKKLYDSVLLSGILTVIDLSTKAPLSTKAPLSASMIQRYDEHREDLKQLKQFVKAS-LPEKYQEIFADSSK | 357 |
| WP_017643650 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_017647151 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| WP_017648376 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| WP_017649527 | 279 | LLGQIGDEFADLFSVAKKLYDSVLLSGILTVTALSTKAPLSTKAPLSASMIQRYDEHREDLKQLKQFVKAS-LPEKYQEIFTDSSK | 357 |
| WP_017771611 | 279 | LLGQIGDEFADLFSAAKKLYDSVLLSGILTVIDLSTKAPLSTKAPLSASMIQRYDEHREDLKQLKQFVKAS-LPEKYQEIFTDSSK | 357 |
| WP_017771984 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| CFQ25032 | 279 | LLGQIGDEFADLFSAAKKLYDSVLLSGILTVIDLSTKASLSDSMIQRYDEHREDLKQLKQFVKAS-LPEKYQEIFADSSK | 357 |
| CFV16040 | 279 | LLGQIGDEFADLFSVAKKLYDSVLLSGILTVIDLSTKAPLSTKAPLSASMIQRYDEHREDLKQLKQFVKAS-LPEKYQEIFADSSK | 357 |
| KLJ37842 | 279 | LLGQIGDEFADLFSVAKKLYDSVLLSGILTVIDLSTKAPLSTKAPLSASMIQRYDEHREDLKQLKQFVKAS-LPEKYQEIFTDSSK | 357 |
| KLJ72361 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |
| KLL20707 | 279 | LLGQIGDEFADLFSAAKKLYDSVVKKLYDSVLLSGILTVIDLSTKAPLSTKAPLSASMIQRYDEHREDLKQLKQFVKAS-LPEKYQEIFTDSSK | 357 |
| KLL42645 | 279 | LLGQIGDEFADLFSVAKKLYDSVLLSGILTVIDLSTKAPLSTKAPLSASMIQRYDEHREDLKQLKQFVKAS-LPEKYQEIFADSSK | 357 |
| WP_047207273 | 279 | LLGQIGDEFADLFSAAKKLYDSVLLSGILTVIDLSTKAPLSTKAPLSASMIQRYDEHREDLKQLKQFVKAS-LPEKYQEIFADSSK | 357 |

-continued

```
WP_47209694      279  LLGQIGDEFADLFSAAKKLYDSVLLSGILTVDLSTKAPLSASMIQRYDEHREDLKQLKQFVKAS-LPEKYQEIFADSSK  357
WP_050198062     279  LLGQIGDEFADLFSAAKKLYDSVLLSGILTVIDLSTKAPLSASMIQRYDEHREDLKQLKQFVKAS-LPEKYQEIFADSSK 357
WP_050201642     279  LLGQIGDEFADLFSAAKKLYDSVLLSGILTVIDLSTKAPLSASMIQRYDEHREDLKQLKQFVKAS-LPEKYQEIFADSSK 357
WP_050204027     279  LLGQIGDEFADLFVAKKLYDSVLLSGILTVIDLSTKAPLSASMIQRYDEHREDLKQLKQFVKAS-LPEKYQEIFADSSK  357
WP_050881965     279  LLGQIGDEFADLFSAAKKLYDSVLLSGILTVDLSTKAPLSASMIQRYDEHREDLKQLKQFVKAS-LPEKYQEIFDSSK   357
WP_050886065     279  LLGQIGDEFADLFSAAKKLYDSVLLSGILTVDLSTKAPLSASMIQRYDEHREDLKQLKQFVKAS-LPEKYQEIFADSSK  357
AHN30376         279  LLGQIGDEFADLFSAAKKLYDSVLLSGILTVDLSTKAPLSASMIQRYDEHREDLKQLKQFVKAS-LPEKYQEIFADSSK  357
EA078426         279  LLGQIGDEFADLFSAAKKLYDSVLLSGILTVIDLSTKAPLSASMIQRYDEHREDLKQLKQFVKAS-LPEKYQEIFADSSK 357
CCW42055         279  LLGQIGDEFADLFSAAKKLYDSVLLSGILTVDLSTKAPLSASMIQRYDEHREDLKQLKQFVKAS-LPEKYQEIFADSSK  357
WP_003041502     279  LLGEVGDEYADLFASAKNLYDAILLSGILLSGILTVDDNSTKAPLSASMVKRYEEHQKDLKKKPEDFIKVN-ALDQYNAIFKDKNK 356
WP_037593752     279  LLGEIGDEYADLFASAKNLYDAILLSGILAVDDNTTKAPLSASMVKRYEEHQKDLKKLKDFIKVN-APDQYNAIFKDKNK 357
WP_049516684     279  LLGEIGDEYADLFASAKNLYDAILLSGILAVDDNTTKAPLSASMVKRYEEHQKDLKKLKDFIKVN-APAQYDDIFKDETK 357
GAD46167         279  LLGEIGDEYADLFASAKNLYDAILLSGILAVDDNTTKAPLSASMVKRYEEHQKDLKKLKDFIKVN-APDQYNAIFKDKNK 357
WP_018363470     279  LLGKIGDDYADLFTSSKNLYDAILLSGILTVDDNSTKAPLSASMIKRYVEHHEDLEKLKEFIKAN-KSELYHDIFKDKTQ  357
WP_003043819     278  LLGQIGDQYADLFSAAKNLSDAILLSDILRSNSEVTKAPLSASMVKRYDEHHQDLALLIKTLVRQQ-FPEKYAEIFKDDTK 356
WP_006269658     278  FLGEVGDQYADLFASAKNLYDAILLSGILTVDDNSTKAPLSASMVKRYEEHQKDLKKLKDFIKVN-APDQYNAIFKDKNK 356
WP_048800889     278  LLGKIGDDYADLFTSAKNLYDTILLSGILLAVDDNSTKALLSASMIKRYEEHQDLKKLKDFIKVN-APAQYNAIFKDETK 356
WP_012767106     278  LLAQIGDQYADLFLAAKNLSDAILLSDILRVNSEITKAPLSASMIKRYDEHHQDLTLLKALVRQQ-LPEKYKEIFPDQSK 356
WP_014612333     278  LLAQIGNQYADLFLAAKNLSDAILLSDILRVNSEITKAPLSASMIKRYDEHHQDLTLLKALVRQQ-LPEKYKEIFPDQSK 356
WP_015017095     278  LLAQIGDQYADLFLAAKNLSDAILLSDILRVNSEITKAPLSASMIKRYDEHHQDLTLLKALVRQQ-LPEKYKEIFPDQSK 356
WP_015057649     278  LLAQIGDQYADLFLAAKNLSDAILLSDILRVNSEITKAPLSASMIKRYDEHHQDLTLLKALVRQQ-LPEKYKEIFPDQSK 356
WP_048272215     278  LLAQIGDQYADLFLAAKNLSDAILLSDILRVNSEITKAPLSASMIKRYDEHHQDLTLLKALVRQQ-LPEKYKEIFPDQSK 356
WP_049519324     278  LLAQIGDQYADLFLAAKNLSDAILLSDILRVNSEITKAPLSASMIKRYDEHHQDLTLLKALVRQQ-LPEKYKEIFPDQSK 356
WP_012515931     278  LLAQIGDQYADLFLAAKNLSDAILLSDILTESDEITKAPLSASMIKRYREHHKDLVTLKTLIKDQ-LPEKYQEIFLDKTK 356
WP_021320964     278  LLAQIGDQYADLFLAAKNLSDAILLSDILTESDEITRAPLSASMIKRYREHHKDLVTLKTLIKDQ-LPEKYQEIFLDKTK 356
WP_037581760     278  LLAQIGDQYADLFLAAKNLSDAILLSDILTESDEITKAPLSASMIKRYREHHKDLVTLKTLIKDQ-LPEKYQEIFLDKTK 356
WP_042324281     278  LLAQIGDQYADLFLAAKNLSDAILLSDILTVDDNSTKAPLSASMIKRYEEHHEDLEKLKTFIKVN-NFDKYHEIFKDKSK 356
WP_009854540     279  LLAQIGDQYADLFTAAKNLFTSAKNLYDAILLSGILTVDDNSTKAPLSASMIKRYNEHQVDLKKLKEFIKAN-ASDKDEIFNDRDK 357
WP_012962174     279  LIGQIGDEYADLFTSAKNLYDAILLSGILTVADNTTKAPLSASMIKRYNEHQVDLKKLKEFIKAN-ASDKDEIFNDRDK  357
WP_039695303     279  LLGKIGDDYADLFTSAKNLYDAILLSGILTVDDNSTKAPLSASMIKRYVEHHEDLEKLKEFIKAN-KSELYHDIFKDKNK 357
WP_014334983     278  LLGKVGDNYADLFISAKNLYDAILLSGILTVDDNSTKAPLSASMIKRYVEHHEDLEKLKEFIKIN-KLKLYHDIFKDKTK 356
WP_043099269     278  LLAQIGDQYADLFIAAKKLSDAILLSDIITVKGASTKAPLSASMVQRYEEHQQDLALLKNLVKKQ-IPEKYKEIFDNKEK 356
AHY15608         278  LLAQIGDQYADLFIAAKKLSDAILLSDIITVKGASTKAPLSASMVQRYEEHQQDLALLKNLVKKQ-IPEKYKEIFDNKEK 356
AHY17476         278  LLAQIGDQYADLFIAAKKLSDAILLSDIITVKGASTKAPLSASMVQRYEEHQQDLALLKNLVKKQ-IPEKYKEIFDNKEK 356
ESR09100              ----------------------------------------------------------------------------
AGM98575         278  LLAQIGDQYADLFIAAKKLSDAILLSDIITVKGASTKAPLSASMVQRYEEHQQDLALLKNLVKKQ-IPEKYKEIFDNKEK 356
ALF27331         278  LLAQIGNYAELFLSAKKLYDSILLSGILTVDDNSTKAPLSASMIQRYNEHQMDLAQLKQFIRQK-LSDKYNEVFSDVSK   356
WP_018372492     276  LLSKIDEEYAALFDLAKKVYDAVLLSNILTVKEKNTKAPLSASMIKRYEEHKDDLKAPKRFPRER-LPEKYETMFKDLTK  354
WP_045618028     279  LIVQIGDDFADLFLVAKKLYDAILLSGILTVDPSTKAPLSASMIDRYENHQKDLAAALKQFIKTN-LPEKYDEVFSDQSK  357
WP_045635197     278  LLGQIGDDFTDLFVSAKKLYDAILLSGILTVDDNSTKAPLSASMIERYENHQNDLAAALKQFIKNN-LPEKYDEVFSDQSK 356
WP_002263549     278  LLAQIGDNYAELFLSAKKLYDAILLSGILTVDVGTKAPLSASMIQRYNEHQMDLAQLKQFIRQK-LSDKYNEVFSDVSK   356
WP_002263887     278  LLGKIGDDYADLFTLAKNLYDAILLSGILTADDSSTKAPLSASMIKRYAEHHEDLEKLKEFIKAN-KPELYHDIFKDETK  356
WP_002264920     278  LLGKIGDDYADLFTLAKNLYDAILLSGILTADDSSTKAPLSASMIQRYNEHQMDLAQLKQFIRQK-LSDKYNEVFSDVSK  356
WP_002269043     278  LLAQIGDNYAELFLSAKKLYDSILLSGILTVDDNSTKAPLSASMIQRYNEHQMDLAQLKQFIRQK-LSDKYNEVFSDVSK  356
WP_002269448     278  LLAQIGDNYAELFLSAKKLYDSILLSGILTVDDNSTKAPLSASMIQRYNEHQMDLAQLKQFIRQK-LSDKYNEVFSDVSK  356
WP_002271977     278  LLGKIGDDYADLFTLAKNLYDAILLSGILTVDDNSTKAPLSASMIQRYNEHQMDLAQLKQFIRQK-LPEKYETMFKDLTK  356
WP_002272766     278  LLAQIGDNYAELFLSAKKLYDAILLSGILTVDDNSTKAPLSASMIQRYNEHQMDLAQLKQFIRQK-LSDKYNEVFSDVSK  356
WP_002273241     278  LLAQIGDNYAELFLSAKKLYDSILLSGILTVDDNSTKAPLSASMIQRYNEHQMDLAQLKQFIRQK-LSDKYNEVFSDVSK  356
WP_002275430     278  LLTQIGDNYAELFLSAKKLYDSILLSGILTVDDNSTKAPLSASMIQRYNEHQMDLAQLKQFIRQK-LSDKYNEVFSDVSK  356
WP_002276448     278  LLAQIGDNYAELFLSAKKLYDAILLSGILTADDSSTKAPLSASMIQRYNEHQMDLAQLKQFIRQK-LSDKYNEVFSDVSK  356
WP_002277050     278  LLGKIGDDYADLFTLAKNLYDAILLSGILTADDSSTKAPLSASMIKRYAEHHEDLEKLKEFIKAN-KPELYHDIFKDETK  356
WP_002273764     278  LLAQIGDNYAELFLSAKKLYDSILLSGILTADDSSTKAPLSASMIQRYNEHQMDLAQLKQFIRQK-LSDKYNEVFSDVSK  356
WP_002279025     278  LLAQIGDNYAELFLSAKKLYDSILLSGILTADDSSTKAPLSASMIQRYNEHQMDLAQLKQFIRQK-LSDKYNEVFSDVSK  356
```

-continued

| ID | Start | Sequence | End |
|---|---|---|---|
| WP_002279859 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002280230 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002281696 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002282247 | 278 | LLGKIGDDYADLFTLAKNLYDAILLSGILTVTDVSTKAPLSASMIKRYAEHHEDLEKLKEFIKAN-KPELYHDIFKDETK | 356 |
| WP_002283906 | 278 | LLAQIGDNYAELFLSAKKLYDSILLSGILTVTDVGTKAPLSASMIQRYNEHQMDLAQLKQFIRQK-LSDKYNEVFSDVSK | 356 |
| WP_002283846 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002287255 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002288990 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002289641 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_002290427 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002295753 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002296423 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002304487 | 278 | LLGEIGDEYADLFASAKNLYDAILLSGILAVDDNTTKAPLSASMVKRYKEHKEELAAFKRFIKEK-LPKKYEIFKDDTK | 356 |
| WP_002305844 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002307203 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002310390 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002352408 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_012997688 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_014677909 | 278 | LLAQIGDNYAELFLSAKKLYDSILLSGILTVTDVGTKAPLSASMIQRYNEHQMDLAQLKQFIRQK-LSDKYNEVFSDVSK | 356 |
| WP_019312892 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019313659 | 278 | LLAQIGDNYAELFLSAKKLYDSILLSGILTVTDVGTQAPLSASMIQRYNEHQMDLAQLKQFIRQK-LSDKYNEVFSDVSK | 356 |
| WP_019314093 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_019315370 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019803776 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019805234 | 278 | LLAQIGDNYAELFLSAKKLYDSILLSGILTVTDVGTKAPLSASMIQRYNEHQMDLAQLKQFIRQK-LSDKYNEVFSDVSK | 356 |
| WP_024783594 | 278 | LLAQIGDNYAELFLSAKKLYDSILLSGILTADDSSTKAPLSASMIKRYAEHHEDLEKLKEFIKAN-KPELYHDIFKDETK | 356 |
| WP_024784288 | 278 | LLAQIGDNYAELFLSAKKLYDSILLSGILTVTDVSTKAPLSASMIQRYNEHQMDLVQLKQFIRQK-LSDKYNEVFSDVSK | 356 |
| WP_024784666 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_024784894 | 278 | LLAQIGDNYAELFLAKNLYDAILLSGILTADDSSTKAPLSASMIKRYAEHHEDLEKLKEFIKAN-KPELYHDIFKDETK | 356 |
| WP_024786433 | 278 | LLGKIGDDYADLFTLAKNLYDAILLSGILTVTDVSTKAPLSASMIQRYNEHQMDLTQLKQFIRQK-LSDKYNEVFSDVSK | 356 |
| WP_049473442 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_049474547 | 271 | LLAQIGDNYAELFLSAKKLYDSILLSGILTVTDVSTKAPLSASMIERYENHQKDLATLKQFIKTN-LPEKYDEVFSDQSK | 349 |
| EMC03581 | 279 | LLGQIGDDFADLFVAAKKLYDSILLSGILTVTDPSTKAPLSASMIERYENHQKDLAVLKQFIKNN-LPEKYDEVFSDQSK | 357 |
| WP_000428612 | 279 | LLGQIGDDFADLFVAKKLYDSILLAGILSVKDPGTKAPLSASMIERYDNHQNDLSALKQFVRRN-LPEKYAEVFSDDSK | 357 |
| WP_000428613 | 278 | LLGQIGDVYADLFVVAKKLYDSILLAGILSVKDPGTKAPLSASMIERYENHQRDLAALKQFIKNN-LSEKYAEVFSDQSK | 356 |
| WP_049523028 | 247 | LLAQIGDQYADLFTLAKNLSDAILLSDILTVKGVNTKAPLSASMVQRFNEHQDLKLLKLVKVQ-LPEKYKEIFDIKDK | 325 |
| WP_003107102 | 280 | LLTQIGDEYADLFAKNLSDAILLSDILTVNGDGTQAPLSASLIKRYEEHRQDLALLLKQMFKEQ-LPDLYRDVFTDENK | 358 |
| WP_054279288 | 279 | LLGQIGDFADLFVAKKLYDAILLSGILTVTDPSTKAPLSASMIERYENHQKDLAALKQFIKNN-LPEKYDEVFSDQSK | 357 |
| WP_049531101 | 279 | LLGQIGFADLFVAKKLYDAILLSGILTVTDPSTKAPLSASMIERYONHQNDLASLKQFIKNN-LPEKYDEVFSDQSK | 357 |
| WP_049538452 | 279 | LLGQIGDDFADLFVAKKLYDAILLSGILTVTDPSTKAPLSASMIERYENHQKDLAALKQFIKNN-LPEKYDEVFSDQSK | 357 |
| WP_049549711 | 280 | LLGQIGDFADLFVAKKLYDAILLSGILTVTDPSTKAPLSASMIERYENHQKDLTTLKQFIKNN-LPEKYDEVFSDQSK | 358 |
| WP_007896501 | 232 | LLAEIGDHYADLFLAAKNLSDAILLSDILTLSDENTRAPLSASMIKRYEEHQEDLALLKKLVKEQ-MPEKYWEIFSNAKK | 310 |
| EFR44625 | 278 | LLGIGDHYADLFLAAKNLSDAILLSDILTLSDENTRAPLSASMIKRYEEHQEDLALLKKLVKEQ-MPEKYWEIFSNAKK | 356 |
| WP_002897477 | 278 | LLGQIGDFADLFIAKKLYDAILLSGILTVTDPSTKAPLSASMIERYENHQKDLAALKQFIKNN-LPEKYVEVFSDQSK | 356 |
| WP_002906454 | 279 | LLGQIGDGFADLFIVAKKLYDAILLSGILTVTDPSTKAPLSASMIERYENHQRDLAALKQFIKNN-LSEKYAEVFSDQSK | 357 |
| WP_009729476 | 278 | LLGQIGDDFADLFVAKKLYDAILLSGILTVTNPSTKAPLSASMIERYENHQKDLASLKQFIKNN-LPEKYDEVFSDQSE | 356 |
| CQR24647 | 278 | LLGIIGDEYADVFVAAKVYDSILLSGILTTNNHSTKAPLSASMIDRYDEHNSDKKLLRDFIRTNIGKEVFKEVFYDTSK | 356 |
| WP_000066813 | 279 | LLGQIGDDFADLFIVAKKLYDAILLSGILTVKDLSTRAPLSASMIERYENHQKDLAALKQFIKNN-LPEKYDEVFSDQSK | 357 |
| WP_009754323 | 279 | LLGQIGDDFADLFVAKKLYDAILLSGILTVKDLSTKAPLSASMIERYENHQKDLAALKQFIKNN-LPEKYDEVFSDQSK | 357 |
| WP_044674937 | 278 | LLGKIGDDYADLFIATKSLYDGILLAGILSTTDSTTKAPLSSSMVNRYEEHKDLALLKNFIHQN-LSDSYKEVENDKLK | 356 |
| WP_044676715 | 278 | LLGKIGDDYADLFIATKSLYDGILLAGILSTTDSTTKAPLSSSMVNRYEEHQKDLALLKNFIHQN-LSDSYKEVENDKLK | 356 |
| WP_044680361 | 278 | LLGKIGDDYADLFIATKSLYDGILLAGILSTTDSTTKAPLSSSMVNRYEEHKDLALLKNFIHQN-LSDSYKEVENDKLK | 356 |
| WP_044681799 | 278 | LLGKIGDDYADLFIATKSLYDGILLAGILSTTDSTTKAPLSSSMVNRYEEHKDLALLKNFIHQN-LSDSYKEVENDKLK | 356 |

-continued

| | | | |
|---|---|---|---|
| WP_049533112 | 278 | LLGEIGDEYADLFASAKNLYDAILLSGILTVDDNSTKAPLSASMVKRYEEHQKDLKKLKDFIKVN-APDQYNAIFKDKNK | 356 |
| WP_029090905 | 244 | LADVLADEYDLLLTAQKIYSAIILDESMDGYEYFA-----EAKKESYRKHQBELVLVKKMLKSNaITNDERAKF---EY | 315 |
| WP_006506696 | 284 | VEKDLGE-YVEFVDALHNVYSWVELQTIMGATHTD-NASISEAMVSRYNKHHDDLKLLKDCIKNN-VPNKYFDMFRNDSE | 360 |
| AIT42264 | 278 | LLAQIGDQYADLFLAAKNLSDAILLSDILRVNTEITKAPLSASMIKRYDEHHQDLTLLKALVRQQ-LPEKYKEIFFDQSK | 356 |
| WP_034440723 | 284 | LLSNIDEGYRDVFLQAKNVYNAIELSKILKTDGKETKAPLSAQMVELYNQHREDLKKYKYDYIKAY-LPEKYGETFKDATK | 362 |
| AKQ21048 | 278 | LLAQIGDQYADLFLAAKNLSDAILLSDILRVNTEITKAPLSASMIKRYDEHHQDLTLLKALVRQQ-LPEKYKEIFFDQSK | 356 |
| WP_004636532 | 277 | LLGMTDDVFLDVFMAAKNVYDAVEMSAIISTDTGNSKAVLSNQMINFYDEHKVDLAQLKQFKTH-LPDKYYECFSDPSK | 355 |
| WP_002364836 | 284 | LLGMIGDEYSDVFLAAKNVYDAVELSTILADSDKKSHAKLSSSMIVRFTEHQDLKKFKPKRFIREN-CPDEYDNLFKNEQK | 362 |
| WP_016631044 | 235 | ILAKVGDEYSDVFLAAKNVYDAVELSTILADSDKKSHAKLSSSMIVRFTEHQEDLKKFKRFIREN-LPEKTAIFFKDSSK | 313 |
| EMS75795 | 21 | ILEKSGEEFRDVFLQAKKVYDAILLSTKKQNSKAKLSLGMIERYDSHKKDLEELKQFVKAN-LPEKTAIFFKNEQK | 99 |
| WP_002373311 | 284 | ILAKVGDEYSDVFLAAKNVYDAVELSTILADSDKKSHAKLSSSMIVRPTEHQEDLKKFKRFIREN-CPDEYDNLFKNEQK | 362 |
| WP_002378009 | 284 | ILAKVGDEYSDVFLAAKNVYDAVELSTILADSDKKSHAKLSSSMIVRPTEHQEDLKNFKRFIREN-CPDEYDNLFKNEQK | 362 |
| WP_002407324 | 284 | ILAKVGDEYSDVFLAAKNVYDAVELSTILADSDKKSHAKLSSSMIVRPTEHQEDLKNFKRFIREN-CPDEYDNLFKNEQK | 362 |
| WP_002413717 | 284 | ILAKVGDEYSDVFLAAKNVYDAVELSTILADSDKKSHAKLSSSMIVRPTEHQEDLKKFKRFIREN-CPDEYDNLFKNEQK | 362 |
| WP_010775580 | 286 | ILAKVGDEYSDVFLAAKNVYDAVELSTILADSDKKSHAKLSSSMIVRPTEHQEDLKKFKRFIREN-CPDEYDNLFKNEQK | 364 |
| WP_010818269 | 284 | ILAKVGDEYSDVFLAAKNVYDAVELSTILADSDKKSHAKLSSSMIVRPTEHQEDLKKFKRFIREN-CPDEYDNLFKNEQK | 362 |
| WP_010824395 | 284 | ILAKVGDEYSDVFLAAKNVYDAVELSTILADSDKKSHAKLSSSMIVRPTEHQEDLKNFKRFIREN-CPDEYDNLFKNEQK | 362 |
| WP_016622645 | 284 | ILAKVGDEYSDVFLAAKNVYDAVELSTILADSDKKSYAKLSSSMIVRPTEHQEDLKKFKRFIREN-CPDEYDNLFKNEQK | 362 |
| WP_033624816 | 284 | ILAKVGDEYSDVFLAAKNVYDAVELSTILADSDKKSHAKLSSSMIVRPTEHQEDLKKFKRFIREN-CPDEYDNLFKNEQK | 362 |
| WP_033625576 | 284 | ILAKVGDEYSDVFLAAKNVYDAVELSTILADSDKKSHAKLSSSMIVRPTEHQEDLKKFKRFIREN-CPDEYDNLFKNEQK | 362 |
| WP_033789179 | 284 | ILAKVGDEYSDVFLAAKNVYDAVELSTILADSDKKSHAKLSSSMIVRPTEHQEDLKNFKRFIREN-CPDEYDNLFKNEQK | 362 |
| WP_002310644 | 282 | LLEKIGDDYIDLFVQAKNVYQAKKVYDAILLSEILSDSTKNTRAKLSAGMIRRYDAHKEDLVLLKRFVKEN-LPKKYRAFFGDNSV | 360 |
| WP_002312694 | 283 | LLEKIGDDYIDLFVQAKNVYQAKKVYDAILLSEILSDSTKNTRAKLSAGMIRRYDAHKEDLVLLKRFVKEN-LPKKYRAFFGDNSV | 361 |
| WP_002314015 | 283 | LLEKIGDDYIDLFVQAKNVYQAKKVYDAILLSEILSDSTKNTRAKLSAGMIRRYDAHKEDLVLLKRFVKEN-LPKKYRAFFGDNSV | 361 |
| WP_002320716 | 282 | LLEKIGDDYIDLFVQAKNVYQAKKVYDAILLSEILSDSTKNTRAKLSAGMIRRYDAHKEDLVLLKRFVKEN-LPKKYRAFFGDNSV | 360 |
| WP_002330729 | 283 | LLEKIGDDYIDLFVQAKNVYQAKKVYDAILLSEILSDSTKNTRAKLSAGMIRRYDAHKEDLVLLKRFVKEN-LPKKYRAFFGDNSV | 361 |
| WP_002335161 | 283 | LLEKIGDDYIDLFVQAKNVYQAKKVYDAILLSEILSDSTKNTRAKLSAGMIRRYDAHKEDLVLLKRFVKEN-LPKKYRAFFGDNSV | 361 |
| WP_002345439 | 283 | LLEKIGDDYIDLFVQAKNVYQAKKVYDAILLSEILSDSTKNTRAKLSAGMIRRYDAHKEDLVLLKRFVKEN-LPKKYRAFFGDNSV | 361 |
| WP_034867970 | 276 | LLEKIGDEYLDIFLQAKNVYDAVLLSEILSSTVKHTAKLSSGMVERYERHKADLAKFKQFVKEN-VPLKKYRAFFGDNSV | 354 |
| WP_047937432 | 283 | LLEKIGDEYLDIFLQAKNVYDAVLLSEILSEIISSTVKHTAKLSSGMVERYERHKADLAKFKQFVKEN-VPQKATVFFKDTTK | 361 |
| WP_010720994 | 276 | LLEKIGDEYLDIFLQAKKVYHDAILLSEILSEIISSTVKHTQAKLSSGMVERYERHKADLAKFKQFVKEN-VPQKATVFFKDTTK | 354 |
| WP_010737004 | 276 | LLEKIGDEYLDIFLQAKKVYHDAILLSEILSEIISSTVKHTQAKLSSGMVERYERHKADLAKFKQFVKEN-VPQKATVFFKDTTK | 354 |
| WP_034700478 | 276 | LLEKIGDEYLDIFLQAKKVYHDAILLSEILSEIISSTVKHTQAKLSSGMVERYERHKADLAKFKQFVKEN-VPQKATVFFKDTTK | 354 |
| WP_007209003 | 281 | LLAIIGDEYGDIFVAAQNLYQAILLAGILTSEK-TRAKLSASMIQRYEEHAKDLKLLKRFVKEH-IPDKYAEIFNDATK | 358 |
| WP_023519117 | 276 | LLEKTSDDYAELFLKAKGVYDAILLSKSDDETKAKLSANMKLRFEEHQRDLKQLKELVRRD-LPKKYDFFKNRSK | 354 |
| WP_010770040 | 279 | LLAIIGDEYAELFVAAKNAYSAIKSVYDAVALSGILSVTDGDTKAKLSASMVERYEAHQDLVQFQIFIRKE-LPEMYAPIFRDNSV | 357 |
| WP_048604708 | 275 | LLGEIGDEYAELFVAAKNVYDAIELSGILTVTDNSTKAKLSAGMIKRYEDHKTDLKLFKEFIRKN-LPEKYHEIFNDKNT | 353 |
| WP_010750235 | 276 | LLRKSNEEMIDVFLQVKKVYDAILLSDILSTKMKDTKAKLSAGMIERYQNHKKDLEELKQFVRAH-LHEKVTVFFKDSSK | 354 |
| AII16583 | 317 | LLAQIGDQYADLFLAAKNLSDAILLSDILRVNTEITKAPLSASMIKRYDEHHQDLTLLKALVRQQ-LPEKYKEIFFDQSK | 395 |
| WP_029073316 | 290 | KQPLLGD-CVEFIDLLHDIYSWVELQNILGSAHTS-EPSISAAMIQRYEDHKNDLKLLKDVIRKY-LPKKYFEVFRDEKS | 366 |
| WP_031589969 | 290 | KQPLLGD-CVEFIDLLHDIYSWVELQNILGSAHTS-EPSISAAMIQRYEDHKNDLKLLKDVIRKY-LPKKYFEVFRDEKS | 366 |
| KDA45870 | 276 | LLAEAGDQYLDIFVAAKKVYDAAILASILDVKDTQTKTVFSQAMIERYEEHQDLIELKRVFKKY-LPEKCHDFFSE-PK | 353 |
| WP_039099354 | 286 | LESSLDDNAHQIIESLQELYSGVLLAGIVPEMQSLS-----QAMITKYDDHQKHLKMLKAVREAL-APEDRQRLKQAYDQ | 359 |
| AKP02966 | 279 | LDSILDDDQFTVLDTANRIYSTITLNEIL----NGESYFSMAKVNQYENHAIDLCKLRDMWHTT---KNEKAV-GLSR | 348 |
| WP_010991369 | 284 | LLALIGDEYAELFVAAKNAYSAVVLSSIITVAETETNAKLSASMIERPDTHEEDLGELKAFIKLH-LPKHYEIFSNTEK | 362 |
| WP_033838504 | 284 | LLALIGDEYAELFVAAKNAYSAVVLSSIITVAETETNAKLSASMIERPDTHEEDLGELKAFIKLH-LPKHYEIFSNTEK | 362 |
| EHN60060 | 287 | LLALIGDEYAELFVAAKNAYSAVVLSSIITVAETETNAKLSASMIERPDTHEEDLGELKAFIKLH-LPKHYEIFSNTEK | 365 |
| EFR89594 | 53 | LLALIGDEYAELFVAAKNAYSAVVLSSIITVAETETNAKLSASMIERPDTHEEDLGELKAFIKLH-LPKHYEIFSNTEK | 131 |
| WP_038409211 | 284 | LLAKIGDEYAEIFVAAKSTYNAVVLSNIITVDTETKAKLSASMIERPDKHAKDLKRLKAFFKMQ-LPEKFNEVFNDIEK | 362 |
| EFR95520 | | | |
| WP_003723650 | 284 | LLAIIGDEYAELFVAAKNTYNAVVLSSIITVDTETNAKLSASMIERPDAHEKDLVELKAFIKLN-LPKQYBEIFSNAAI | 362 |
| WP_003727705 | 284 | LLAIIGDEYAELFVAAKNTYNAVVLSSIITVATETNAKLSASMIERPDAHEKELGELKAFIKLH-LPKQYQEIFNNAEI | 362 |
| WP_003730785 | 284 | LLAIIGDEYAELFVAAKNTYNAVVLSSIITVATETNAKLSASMIERPDAHEKELGELKAFIKLH-LPKQYQEIFNNAEI | 362 |

-continued

| ID | Start | Sequence | End |
|---|---|---|---|
| WP_003733029 | 284 | LLAIIGDEFAEVFVAAKNAYNAVVLSNIITVDSTTRAKLSASLIERPENHKEDLKKMKRFVRTY-LPEKYDEIFDDTEK | 362 |
| WP_003739838 | 284 | LLAIIGDEYAELFVAAKNTYNAVVLSSIITVTDTETNAKLSASMIERPDAHEKDLSELKAFIKLH-LPKQYEIFSNVAI | 362 |
| WP_014601172 | 284 | LLAIIGDEYAELFVAAKNTYNAVVLSSIITVTATETNAKLSASMIERPDAHEKDLGELKAFIKLH-LPKQYQEIFNNAAI | 362 |
| WP_023548323 | 284 | LLAIIGDEYAELFVAAKNTYNAVVLSSIITVTDTETNAKLSASMIERPDAHEKDLVELKAFIKLN-LPKQYQEIFNNAAI | 362 |
| WP_031665337 | 284 | LLAIIGDEYAELFVAAKNTYNAVVLSSIITVTDTETNAKLSASMIERPDAHEKDLVELKAFIKLN-LPKQYEIFSNAAI | 362 |
| WP_031669209 | 284 | LLAIIGDEFAEVFVAAKNAYNAVVLSNIITVDSTTRAKLSASLIERPENHKEDLKKMKRFVRTY-LPEKYDEIFDDTEK | 362 |
| WP_033920898 | 284 | LLAIIGDEYAELFVAAKNTYNAVVLSSIITVTDTETNAKLSASMIERPDAHEKDLVELKAFIKLN-LPKQYEIFSNAAI | 362 |
| AKI42028 | 287 | LLAIIGDEYAELFVAAKNTYNAVVLSSIITVTATETNAKLSASMIERPDAHEKDLGELKAFIKLH-LPKQYQEIFNNAAI | 365 |
| AKI50529 | 287 | LLAIIGDEYAELFVAAKNTYNAVVLSSIITVTDTETNAKLSASMIERPDAHEKDLVELKAFIKLN-LPKQYEIFSNAAI | 365 |
| EFR83390 | | | |
| WP_046323366 | 284 | LLARVGDEYAEIFVAAKNAYNAVVLSSIITVSNTETKAKLSASMIERPDKHDKDLKRMKAFFKVR-LPENFNEVFRNDVEK | 362 |
| AKE81011 | 294 | LLAQIGDQYADLFLAAKNLSDAILLSDILRVNTEITKAPLSASMIKRYDEHHQDLTLLKALVRQQ-LPEKYKEIFFDQSK | 372 |
| CUO82355 | 288 | VENDLGE-YVEFIDSLHNIYSWVELQTIMGATHTD-NASISEAMVSRYNKHHEDLQLLKKCIKDN-VPKKYFDMFRNDSE | 364 |
| WP_033162887 | 289 | LQSELGE-YIEFIEMLHNIYSWELQAILGATHTD-NPSISAAMVERYEEHKKDLRVLKKVIREE-LPDKYNEVFRKDNR | 365 |
| AGZ01981 | 311 | LLAQIGDQYADLFLAAKNLSDAILLSDILRVNTEITKAPLSASMIKRYDEHHQDLTLLKALVRQQ-LPEKYKEIFFDQSK | 389 |
| AKA60242 | 278 | LLAQIGDQYADLFLAAKNLSDAILLSDILRVNTEITKAPLSASMIKRYDEHHQDLTLLKALVRQQ-LPEKYKEIFFDQSK | 356 |
| AKS40380 | 282 | LLAQIGDQYADLFLAAKNLSDAILLSDILRVNTEITKAPLSASMIKRYDEHHQDLTLLKALVRQQ-LPEKYKEIFFDQSK | 360 |
| 4UN5_B | 357 | -NGYAG YIDG G ASQEEFYKFIKPILEK-M--DGTEELLv--KLNREDLLRKQRTFDNGS̲IPHQIHLGEL | 419 |
| WP_010922251 | 358 | -NGYAG YIEN G VKQDEFYKYLKNILSK-IkIDGSDYFL--DKIEREDFLRKQRTFDNGSIPHQIHLQEM | 422 |
| WP_039695303 | 357 | -DGYAG YIDG K TTQETFYKYIKNLLSK-F--EGTDYFL--DKIEREDFLRKQRTFDNGSIPYQIHLGEL | 419 |
| WP_045635197 | 169 | -----G SINR -------------K-----TSDYVk-----------------------------EA | 183 |
| 5AXW_A | 41 | -NGYAG YIDG G ASQEEFYKFIKPILEK-M--DGTEELLa--KLNREDLLRKQRTFDNGSIPHQIHLGEL | 103 |
| WP_099880683 | 357 | -NGYAG YIDG G ASQEEFYKFIKPILEK-M--DGTEELLv--KLNREDLLRKQRTFDNGSIPYQIHLGEL | 419 |
| WP_010922251 | 357 | -NGYAG YIDG G ASQEEFYKFIKPILEK-M--DGTEELLa--KLNREDLLRKQRTFDNGSIPYQIHLGEL | 419 |
| WP_011054416 | 357 | -NGYAG YIDG G ASQEEFYKFIKPILEK-M--DGTEELLa--KLNREDLLRKQRTFDNGSIPYQIHLGEL | 419 |
| WP_011284745 | 357 | -NGYAG YIDG G ASQEEFYKFIKPILEK-M--DGTEELLa--KLNREDLLRKQRTFDNGSIPHQIHLGEL | 419 |
| WP_011285506 | 357 | -NGYAG YIDG G ASQEEFYKFIKPILEK-M--DGTEELLv--KLNREDLLRKQRTFDNGSIPHQIHLGEL | 419 |
| WP_011527619 | 357 | -NGYAG YIDG G ASQEEFYKFIKPILEK-M--DGTEELLa--KLNREDLLRKQRTFDNGSIPYQIHLGEL | 419 |
| WP_012560673 | 357 | -NGYAG YIDG G ASQEEFYKFIKPILEK-M--DGTEELLa--KLNREDLLRKQRTFDNGSIPHQIHLGEL | 419 |
| WP_014407541 | 357 | -NGYAG YIDG G ASQEEFYKFIKPILEK-M--DGTEELLv--KLNREDLLRKQRTFDNGSIPHQIHLGEL | 419 |
| WP_020905136 | 357 | -NGYAG YIDG G ASQEEFYKFIKPILEK-M--DGTEELLa--KLNREDLLRKQRTFDNGSIPHQIHLGEL | 419 |
| WP_023080005 | 357 | -NGYAG YIDG G ASQEEFYKFIKPILEK-M--DGTEELLa--KLNREDLLRKQRTFDNGSIPHQIHLGEL | 419 |
| WP_023610282 | 357 | -NGYAG YIDG G ASQEEFYKFIKPILEK-M--DGTEELLa--KLNREDLLRKQRTFDNGSIPYQIHLGEL | 419 |
| WP_030125963 | 357 | -NGYAG YIDG G ASQEEFYKFIKPILEK-M--DGTEELLa--KLNREDLLRKQRTFDNGSIPHQIHLGEL | 419 |
| WP_030126706 | 357 | -NGYAG YIDG G ASQEEFYKFIKPILEK-M--DGTEELLa--KLNREDLLRKQRTFDNGSIPYQIHLGEL | 419 |
| WP_031488318 | 357 | -NGYAG YIDG G ASQEEFYKFIKPILEK-M--DGTEELLa--KLNREDLLRKQRTFDNGSIPYQIHLGEL | 419 |
| WP_032460140 | 357 | -NGYAG YIDG G ASQEEFYKFIKPILEK-M--DGTEELLa--KLNREDLLRKQRTFDNGSIPHQIHLGEL | 419 |
| WP_032461047 | 357 | -NGYAG YIDG G ASQEEFYKFIKPILEK-M--DGTEELLa--KLNREDLLRKQRTFDNGSIPHQIHLGEL | 419 |
| WP_032462016 | 182 | -NGYAG YIDG G ASQEEFYKFIKPILEK-M--DGTEELLa--KLNREDLLRKQRTFDNGSIPHQIHLGEL | 244 |
| WP_032462936 | 357 | -NGYAG YIDG G ASQEEFYKFIKPILEK-M--DGTEELLa--KLNREDLLRKQRTFDNGSIPHQIHLGEL | 419 |
| WP_032464890 | 357 | -NGYAG YIDG G ASQEEFYKFIKPILEK-M--DGTEELLa--KLNRKDLLRKQRTFDNGSIPYQIHLGEL | 419 |
| WP_033888930 | 357 | -NGYAG YIDG G ASQEEFYKFIKPILEK-M--DGTEELLa--KLNREDLLRKQRTFDNGSIPHQIHLGEL | 419 |
| WP_038431314 | 357 | -NGYAG YIDG G ASQEEFYKFIKPILEK-M--DGTEELLa--KLNREDLLRKQRTFDNGSIPHQIHLGEL | 419 |
| WP_038432938 | 357 | -NGYAG YIDG G ASQEEFYKFIKPILEK-M--DGTEELLv--KLNREDLLRKQRTFDNGSIPYQIHLGEL | 419 |
| WP_038434062 | 357 | -NGYAG YIDG G ASQEEFYKFIKPILEK-M--DGTEELLa--KLNREDLLRKQRTFDNGSIPHQIHLGEL | 419 |
| BAQ51233 | 268 | -NGYAG YIDG G ASQEEFYKFIKPILEK-M--DGTEELLv--KLNREDLLRKQRTFDNGSIPHQIHLGEL | 330 |
| KGE60162 | | | |
| KGE60856 | | | |
| WP_002989955 | 357 | -NGYAG YIDG G ASQEEFYKFIKPILEK-M--DGTEELLa--KLNREDLLRKQRTFDNGSIPHQIHLGEL | 419 |
| WP_003030002 | 357 | -KGYAG YIEN G VKQDEFYKYLKGILLQ-I--NGSGDFL--DKIDREDFLRKQRTFDNGSIPHQIHLGEL | 419 |
| WP_003065552 | 360 | -NGYAG YIEN G VKQDEFYKYLKNTLSK-Ia--GSDYFL--DKIEREDFLRKQRTFDNGSIPHQIHLQEM | 422 |
| WP_001040076 | 358 | -DGYAG YIEG K TNQEAFYKYLSKLLTK-Q--EGSEYFL--EKIKNEDFLRKQRTFDNGSIPHQVHLTEL | 420 |
| WP_001040078 | 358 | -DGYAG YIEG K TNQEAFYKYLSKLLTK-Q--EDSENFL--EKIKNEDFLRKQRTFDNGSIPHQVHLTEL | 420 |

```
-continued

WP_001040080    358 -DGYAG YIEG K TNQEAFYKYLSKLLTK-Q--EDSENFL--EKIKNEDFLRKQRTFDNGSIPHQVHLTEL 420
WP_001040081    358 -DGYAG YIEG K TNQEAFYKYLSKLLTK-Q--EDSENFL--EKIKNEDFLRKQRTFDNGSIPHQVHLTEL 420
WP_001040083    358 -DGYAG YIEG K TNQEAFYKYLSKLLTK-Q--EDSENFL--EKIKNEDFLRKQRTFDNGSIPHQVHLTEL 420
WP_001040085    358 -DGYAG YIEG K TNQEAFYKYLSKLLTK-Q--EDSENFL--EKIKNEDFLRKQRTFDNGSIPHQVHLTEL 420
WP_001040087    358 -DGYAG YIEG K TNQEAFYKYLSKLLTK-Q--EDSENFL--EKIKNEDFLRKQRTFDNGSIPHQVHLTEL 420
WP_001040088    358 -DGYAG YIEG K TNQEAFYKYLSKLLTK-Q--EDSENFL--EKIKNEDFLRKQRTFDNGSIPHQVHLTEL 420
WP_001040089    358 -DGYAG YIEG K TNQEAFYKYLSKLLTK-Q--EDSENFL--EKIKNEDFLRKQRTFDNGSIPHQVHLTEL 420
WP_001040090    358 -DGYAG YIEG K TNQEAFYKYLSKLLTK-Q--EDSENFL--EKIKNEDFLRKQRTFDNGSIPHQVHLTEL 420
WP_001040091    358 -DGYAG YIEG K TNQEAFYKYLSKLLTK-Q--EDSENFL--EKIKNEDFLRKQRTFDNGSIPHQVHLTEL 420
WP_001040092    358 -DGYAG YIEG K TNQEAFYKYLSKLLTK-Q--EDSENFL--EKIKNEDFLRKQRTFDNGSIPHQVHLTEL 420
WP_001040094    358 -DGYAG YIEG K TNQEAFYKYLSKLLTK-Q--EDSEYLL--EKIKNEDFLRKQRTFDNGSIPHQVHLTEL 420
WP_001040095    358 -DGYAG YIEG K TNQEAFYKYLSKLLTK-Q--EDSENFL--EKIKNEDFLRKQRTFDNGSIPHQVHLTEL 420
WP_001040096    358 -DGYAG YIEG K TNQEAFYKYLSKLLTK-Q--EGSEYLL--EKIKNEDFLRKQRTFDNGSIPHQVHLTEL 420
WP_001040097    358 -DGYAG YIEG K TNQEAFYKYLSKLLTK-Q--EGSEYLL--EKIKNEDFLRKQRTFDNGSIPHQVHLTEL 420
WP_001040098    358 -DGYAG YIEG K TNQEAFYKYLSKLLTK-Q--EGSEYLL--EKIKNEDFLRKQRTFDNGSIPHQVHLTEL 420
WP_001040099    358 -DGYAG YIEG K TNQEAFYKYLSKLLTK-Q--EGSEYLL--EKIKNEDFLRKQRTFDNGSIPHQVHLTEL 420
WP_001040100    358 -DGYAG YIEG K TNQEAFYKYLSKLLTK-Q--EGSEYLL--EKIKNEDFLRKQRTFDNGSIPHQVHLTEL 420
WP_001040104    358 -DGYAG YIEG K TNQGAFYKYLSKLLTK-Q--EDSENFL--EKIKNEDFLRKQRTFDNGSIPHQVHLTEL 420
WP_001040105    358 -DGYAG YIEG K TNQGAFYKYLSKLLTK-Q--EGSEYFL--EKIKNEDFLRKQRTFDNGSIPHQVHLTEL 420
WP_001040106    358 -DGYAG YIEG K TNQGAFYKYLSKLLTK-Q--EGSEYFL--EKIKNEDFLRKQRTFDNGSIPHQVHLTEL 420
WP_001040107    358 -DGYAG YIEG K TNQGAFYKYLSKLLTK-Q--EGSEYFL--EKIKNEDFLRKQRTFDNGSIPHQVHLTEL 420
WP_001040108    358 -DGYAG YIEG K TNQGAFYKYLSKLLTK-Q--EGSEYFL--EKIKNEDFLRKQRTFDNGSIPHQVHLTEL 420
WP_001040109    358 -DGYAG YIEG K TNQGAFYKYLSKLLTK-Q--EGSEYFL--EKIKNEDFLRKQRTFDNGSIPHQVHLTEL 420
WP_001040110    358 -DGYAG YIEG K TNQGAFYKYLSKLLTK-Q--EGSEYFL--EKIKNEDFLRKQRTFDNGSIPHQVHLTEL 420
WP_015058523    358 -DGYAG YIEG K TNQEAFYKYLSKLLTK-Q--EDSEYFL--EKIKNEDFLRKQRTFDNGSIPHQVHLTEL 420
WP_017643650    358 -DGYAG YIEG K TNQEAFYKYLSKLLTK-Q--EDSEYFL--EKIKNEDFLRKQRTFDNGSIPHQVHLTEL 420
WP_017647151    358 -DGYAG YIEG K TNQEAFYKYLSKLLTK-Q--EDSEYFL--EKIKNEDFLRKQRTFDNGSIPHQVHLTEL 420
WP_017648376    358 -DGYAG YIEG K TNQEAFYKYLSKLLTK-Q--EDSENFL--EKIKNEDFLRKQRTFDNGSIPHQVHLTEL 420
WP_017649527    358 -DGYAG YIEG K TNQEAFYKYLSKLLTK-Q--EGSEYFL--EKIKNEDFLRKQRTFDNGSIPHQVHLTEL 420
WP_017771611    358 -DGYAG YIEG K TNQEAFYKYLSKLLTK-Q--EDSENFL--EKIKNEDFLRKQRTFDNGSIPHQVHLTEL 420
WP_017771984    358 -DGYAG YIEG K TNQEAFYKYLSKLLTK-Q--EDSENFL--EKIKNEDFLRKQRTFDNGSIPHQVHLTEL 420
CFQ25032        358 -DGYAG YIEG K TNQEAFYKYLSELLTK-Q--EDSENFL--EKIKNEDFLREQRTEDNGSIPHQVHLTEL 420
CFV16040        358 -DGYAG YIEG K TNQEAFYKYLSELLTK-Q--EDSENFL--EKIKNEDFLREQRTEDNGSIPHQVHLTEL 420
KLJ37842        358 -DGYAG YIEG K TNQEAFYKYLSELLTK-Q--EDSENFL--EKIKNEDFLREQRTEDNGSIPHQVHLTEL 420
KLJ72361        358 -DGYAG YIEG K TNQEAFYKYLSELLTK-Q--EDSENFL--EKIKNEDFLREQRTEDNGSIPHQVHLTEL 420
ELL20707        358 -DGYAG YIEG K TNQEAFYKYLSELLTK-Q--EDSENFL--EKIKNEDFLREQRTEDNGSIPHQVHLTEL 420
KLL42645        358 -DGYAG YIEG K TNQEAFYKYLSELLTK-Q--EGSEYLL--EKIKNEDFLREQRTEDNGSIPHQVHLTEL 420
WP_047207273    358 -DGYAG YIEG K TNQEAFYKYLSELLTK-Q--EGSEYLL--EKIKNEDFLREQRTEDNGSIPHQVHLTEL 420
WP_047209694    358 -DGYAG YIEG K TNQEAFYKYLSELLTK-Q--EDSENFL--EKIKNEDFLREQRTEDNGSIPHQVHLTEL 420
WP_050198062    358 -DGYAG YIES K TNQEAFYKYLSELLTK-Q--EGSEYLL--EKIKNEDFLREQRTEDNGSIPHQVHLTEL 420
WP_050201642    358 -DGYAG YIEG K TNQEAFYKYLSELLTK-Q--EDSENFL--EKIKNEDFLREQRTEDNGSIPHQVHLTEL 420
WP_050204027    358 -DGYAG YIES K TNQEAFYKYLSELLTK-Q--EGSEYFL--EKIKNEDFLREQRTEDNGSIPHQVHLTEL 420
WP_050881965    358 -DGYAG YIEG K TNQEAFYKYLSELLTK-Q--EDSENFL--EKIKNEDFLREQRTEDNGSIPHQVHLTEL 420
WP_050886065    358 -DGYAG YIEG K TNQEAFYKYLSELLTK-Q--EGSEYFL--EKIKNEDFLREQRTEDNGSIPHQVHLTEL 420
AHN30376        358 -DGYAG YIEG K TNQEAFYKYLSELLTK-Q--EGSEYLL--EKIKNEDFLREQRTEDNGSIPHQVHLTEL 420
EA078426        357 -KGYAG YIES G VKQDEFYKYLEGILLQ-I--NGSGDFL--DKIDREDFLREQRTEDNGSIPHIHLQEM 419
CCW42055        358 -KGYAG YIES G VKQDEFYKYLEGILLK-I--NGSGDFL--DKIDCEDFLREQRTEDNGSIPHIHLQEM 420
WP_003041502    358 -NGYAG YIEN G VKQDEFYKYLENTLSK-I--DGSDYFL--DKIDREDFLREQRTEDNGSIPHIHLQEM 420
WP_037593752    357 -KGYAG YIES G VREQDEFYKYLEGILLK-I--NGSGDFL--DKIEREDFLREQRTEDNGSIPHIHLQEM 419
WP_049516684    357 -NGYAG YIES G VKQDEFYKYLEGIILTK-I--NGSDYFL--DKIEREDFLREQRTEDNGSIPHIHLKEL 419
GAD46167        357 -NGYAG YIES G VKQDEFYKYLEGIILTK-I--NGSDYFL--DKIEREDFLREQRTEDNGSIPHIHLKEL 419
WP_018363470    358 -NGYAG YIEN G VKQDEFYKYLEGIILTK-I--NGSDYFL--DKIEREDFLREQRTEDNGSIPHIHLKEL 420
WP_003043819    357 -NGYAG YVGI G ATQEEFYKFIKPILEK-M--DGAEELLa--KLNRDDLLREQRTEDNGSIPHLHLKEL 429
```

-continued

```
WP_006269658     357 -KGYAS YIES G VKQDEFYKYLEGLLLK-I--NGSGDFL---DKIDREDFLREQRTEDNGSIPHQIHLQEM 419
WP_048800889     357 -NGYAG YIEN G VKQDEFYKYLENTLSK-I--DGSGYFL---DKIEREDFLREQRTEDNGSIPHQIHLQEM 419
WP_012767106     357 -NGYAG YIDG G ASQEEFYKFIKPILEK-M--DGTEELLa---KLNREDLLREQRTEDNGSIPHQIHLGEL 419
WP_014612333     357 -NGYAG YIDG G ASQEEFYKFIKPILEK-M--DGTEELLa---KLNREDLLREQRTEDNGSIPHQIHLGEL 419
WP_015017095     357 -NGYAG YIDG G ASQEEFYKFIKPILEK-M--DGTEELLa---KLNREDLLREQRTEDNGSIPHQIHLGEL 419
WP_015057649     357 -NGYAG YIDG G ASQEEFYKFIKPILEK-M--DGTEELLa---KLNREDLLREQRTEDNGSIPHQIHLGEL 419
WP_048327215     357 -NGYAG YIDG G ASQEEFYKFIKPILEK-M--DGTEELLa---KLNREDLLREQRTEDNGSIPHQIHLGEL 419
WP_049519324     357 -NGYAG YIDG G ASQEEFYKFIKPILEK-M--DGTEELLa---KLNREDLLREQRTEDNGSIPHQIHLGEL 419
WP_012515931     357 -NGYAG YIEG Q VSQEEFYKYLKPILAR-L--DGSEPLl1---KIDREDFLREQRTEDNGSIPHQIHLEEL 419
WP_021320964     357 -NGYAG YIEG Q VSQEEFYKYLKPILAR-I--DGSEPLl1---KIDREDFLREQRTEDNGSIPHQIHLEEL 419
WP_037581760     357 -NGYAG YIEG Q VSQEEFYKYLKPILAR-L--DGSEPLl1---KIDREDFLREQRTEDNGSIPHQIHLEEL 419
WP_004232481     357 -NGYAG YIEN G VKQDIFYKHLKSIISE-K--NGGQYFL---DKIEREDFLREQRTEDNGSIPYQIHLQEM 419
WP_009854540     358 -NGYAG YIEN G VKQDEFYKYLENTLSK-I--DGSDYFL---DKIEREDFLRKQRTFDNGSIPHQIHLQEM 420
WP_012962174     358 -NGYAG YIEN G VKQEEFYKYLETTLSK-I--DGSDYFL---DKIEREDFLRKQRTFDNGSIPHQIHLQEM 420
WP_039695303     358 -NGYAG YIEN G VKQDEFYKYLKNILSK-IkiDGSDYFL---DKIDRDFLRKQRTFDNGSIPHQIHLQEM 422
WP_014334983     357 -NGYAG YIDN G VKQDEFYKYLKTILTK-I--DDSDYFL---DKIEREDFLRKQRTFDNGSIPHQIHLQEM 419
WP_003099269     357 -NGYAG YIDG K TSQEEFYKYIKPILLK-L--DGTEKLIs---KLEREDFLRKQRTFDNGSIPHQIHLNEL 419
AHY15608         357 -NGYAG YIDG K TSQEEFYKYIKPILLK-L--DGTEKLIs---KLEREDFLRKQRTFDNGSIPHQIHLNEL 419
AHY17476         357 -NGYAG YIDG K TSQEEFYKYIKPILLK-L--DGTEKLIs---KLEREDFLRKQRTFDNGSIPHQIHLNEL 419
ESR09100             ------ ---- - ---------------------- --------------- --------------------------- ---
AGM98575         357 -NGYAG YIDG K TSQEEFYKYIKPILLK-L--DGTEKLIs---KLEREDFLRKQRTFDNGSIPHQIHLNEL 419
ALF27331         357 -DGYAG YIDG K TNQEAFYKYLKGLLNK-I--EGSGYFL---DKIEREDFLRKQRTFDNGSIPHQIHLQEM 419
WP_018372492     355 -PSYAA YVSG A VTEDDFYKFSKGLLID-V--EGAEYFL---EKIEREDFLRKQRTFDNGAIPNQVHVKEL 432
WP_045618028     358 -DGYAG YIDG K TTQEAFYKYIKNLLSK-L--EGADYFL---DKIEREDFLRKQRTFDNGSIPHQIHLQEM 420
WP_046635197     357 -DGYAG YIDG K TTQETFYKYIKNLLSK-F--EGTDYFL---DKIEREDFLRKQRTFDNGSIPHQIHLQEM 419
WP_002263549     357 -DGYAG YIDG K TNQEAFYKYLKGLLNK-I--EGSGYFL---DKIEREDFLRKQRTFDNGSIPHQIHLQEM 419
WP_002263887     357 -NGYAG YIEN G VKQDEFYKYLKNTLSK-I--AGSDYFL---DKIEREDFLRKQRTFDNGSIPHQIHLQEM 419
WP_002264920     357 -DGYAG YIDG K TNQEAFYKYLKNTLSK-I--AGSDYFL---DKIEREDFLRKQRTFDNGSIPHQIHLQEM 419
WP_002269043     357 -DGYAG YIDG K TNQEAFYKYLKGLLNK-I--EGSGYFL---DKIEREDFLRKQRTFDNGSIPHQIHLQEM 419
WP_002269448     357 -DGYAG YIDG K TNQEAFYKYLKGLLNK-I--EGSGYFL---DKIEREDFLRKQRTFDNGSIPHQIHLQEM 419
WP_002271977     357 -DGYAG YIDG K TNQEAFYKYLKGLLNK-I--EGSGYFL---DKIEREDFLRKQRTFDNGSIPHQIHLQEM 419
WP_002272766     357 -DGYAG YIDG K TNQEAFYKYLKGLLNK-I--EGSGYFL---DKIEREDFLRKQRTFDNGSIPHQIHLQEM 419
WP_002273241     357 -DGYAG YIDG K TNQEAFYKYLKGLLNK-I--EGSGYFL---DKIEREDFLRKQRTFDNGSIPHQIHLQEM 419
WP_002275430     357 -DGYAG YIDG K TNQEAFYKYLKGLLNK-I--EGSGYFL---DKIEREDFLRKQRTFDNGSIPHQIHLQEM 419
WP_002276448     357 -DGYAG YIDG K TNQEAFYKYLKGLLNK-I--EGSGYFL---DKIEREDFLRKQRTFDNGSIPHQIHLQEM 419
WP_002277050     357 -NGYAG YIEN G VKQDEFYKYLKNTLSK-I--AGSDYFL---DKIEREDFLRKQRTFDNGSIPHQIHLQEM 419
WP_002277364     357 -DGYAG YIDG K TNQEAFYKYLKGLLNK-I--EGSGYFL---DKIEREDFLRKQRTFDNGSIPHQIHLQEM 419
WP_002279025     357 -DGYAG YIDG K TNQEAFYKYLKGLLNK-I--EGSGYFL---DKIEREDFLRKQRTFDNGSIPHQIHLQEM 419
WP_002279859     357 -DGYAG YIDG K TNQEAFYKYLKGLLNK-I--EGSGYFL---DKIEREDFLRKQRTFDNGSIPHQIHLQEM 419
WP_002280230     357 -DGYAG YIDG K TNQEAFYKYLKGLLNK-I--EGSGYFL---DQIEREDFLRKQRTFDNGSIPHQIHLQEM 419
WP_002281696     357 -DGYAG YIDG K TNQEAFYKYLKGLLNK-I--EGSGYFL---DKIEREDFLRKQRTFDNGSIPHQIHLQEM 419
WP_002282247     357 -NGYAG YIEN G VKQDEFYKYLKNTLSK-I--TGSDYFL---DKIEREDFLRKQRTFDNGSIPHQIHLQEM 419
WP_002282906     357 -DGYAG YIDG K TNQEAFYKYLKGLLNK-I--EGSGYFL---DKIEREDFLRKQRTFDNGSIPHQIHLQEM 419
WP_002283846     357 -DGYAG YIDG K TNQEAFYKYLKGLLNK-I--EGSGYFL---DKIEREDFLRKQRTFDNGSIPHQIHLQEM 419
WP_002287255     357 -DGYAG YIDG K TNQEAFYKYLKGLLNK-I--EGSGYFL---DKIEREDFLRKQRTFDNGSIPHQIHLQEM 419
WP_002288990     357 -DGYAG YIDG K TNQEAFYKYLKGLLNK-I--EGSGYFL---DKIEREDFLRKQRTFDNGSIPHQIHLQEM 419
WP_002289641     357 -DGYAG YIDG K TNQEAFYKYLKGLLNK-I--EGSGYFL---DKIEREDFLRKQRTFDNGSIPHQIHLQEM 419
WP_002290427     357 -DGYAG YIDG K TNQEAFYKYLKGLLNK-I--EGSGYFL---DKIEREDFLRKQRTFDNGSIPHQIHLQEM 419
WP_002295753     357 -DGYAG YIDG K TNQEAFYKYLKGLLNK-I--EGSGYFL---DKIEREDFLRKQRTFDNGSIPHQIHLQEM 419
WP_002296423     357 -DGYAG YIDG K TNQEAFYKYLKGLLNK-I--EGSGYFL---DKIEREDFLRKQRTFDNGSIPHQIHLQEM 419
WP_002304487     357 -NGYAG YVGA D ATEEEFYKYVKGILNK-V--EGADVWL---DKIDREDFLRKQRTFDNGSIPHQIHLQEM 429
WP_002305844     357 -DGYAG YIDG K TNQEAFYKYLKGLLNK-I--EGSGYFL---DKIEREDFLRKQRTFDNGSIPHQIHLQEM 419
WP_002307203     357 -DGYAG YIDG K TNQEAFYKYLKGLLNK-I--EGSGYFL---DKIEREDFLRKQRTFDNGSIPHQIHLQEM 419
```

-continued

```
WP_002310390   357 --DGYAG YIDG K TNQEAFYKYLKGLLNK-I--EGSGYFL--DKIEREDFLRKQRTFDNGSIPHQIHLQEM 419
WP_002352408   357 --DGYAG YIDG K TNQEAFYKYLKGLLNK-I--EGSGYFL--DKIEREDFLRKQRTFDNGSIPHQIHLQEM 419
WP_012997688   357 --DGYAG YIDG K TNQEAFYKYLKGLLNK-I--EGSGYFL--DKIEREDFLRKQRTFDNGSIPHQIHLQEM 419
WP_014677909   357 --DGYAG YIDG K TNQEAFYKYLKGLLNK-I--EGSGYFL--DKIEREDFLRKQRTFDNGSIPHQIHLQEM 419
WP_019312892   357 --DGYAG YIDG K TNQEAFYKYLKGLLNK-I--EGSGYFL--DKIEREDFLRKQRTFDNGSIPHQIHLQEM 419
WP_019313659   357 --DGYAG YIDG K TNQEAFYKYLKGLLNK-I--EGSGYFL--DKIEREDFLRKQRTFDNGSIPHQIHLQEM 419
WP_019314093   357 --DGYAG YIDG K TNQEAFYKYLKGLLNK-I--EGSGYFL--DKIEREDFLRKQRTFDNGSIPHQIHLQEM 419
WP_019315370   357 --DGYAG YIDG K TNQEAFYKYLKGLLNK-I--EGNGYFL--DKIEREDFLRKQRTFDNGSIPHQIHLQEM 419
WP_019803776   357 --DGYAG YIDG K TNQEAFYKYLKGLLNK-I--EGSGYFL--DKIEREDFLRKQRTFDNGSIPHQIHLQEM 419
WP_019805234   357 --DGYAG YIDG K TNQEAFYKYLKGLLNK-I--EGSGYFL--DKIEREDFLRKQRTFDNGSIPHQIHLQEM 419
WP_024783594   357 --DGYAG YIDG K TNQEAFYKYLKGLLNK-I--EGSGYFL--DKIEREDFLRKQRTFDNGSIPHQIHLQEM 419
WP_024784288   357 --NGYAG YIEN G VKQDEFYKYLKNTLSK-I--TGSDYFL--DQIEREDFLRKQRTFDNGSIPHQIHLQEM 419
WP_024784666   357 --DGYAG YIDG K TNQEAFYKYLKGLLNK-I--EGSDYFL--DKIEREDFLRKQRTFDNGSIPHQIHLQEM 419
WP_024784894   357 --DGYAG YIEN G VKQDEFYKYLKNTLSK-I--AGSDYFL--DKIEREDFLRKQRTFDNGSIPHQIHLQEM 419
WP_024786433   357 --NGYAG YIEN G VKQDEFYKYLKNTLSK-I--AGSDYFL--DKIEREDFLRKQRTFDNGSIPHQIHLQEM 419
WP_049473442   357 --DGYAG YIDG K TNQEAFYKYLKGLLNK-I--EGSGYFL--DKIEREDFLRKQRTFDNGSIPHQIHLQEM 419
WP_049474547   357 --DGYAG YIDG K TNQEAFYKYLKGLLNK-I--EGNGYFL--DKIEREDFLRKQRTFDNGSIPHQIHLQEM 419
EMC03581       350 --DGYAG YIDG K TNQEAFYKYLKGLLNK-I--EGSGYFL--EKIEREDFLRKQRTFDNGSIPHQIHLQEM 412
WP_000428612   358 --DGYAG YIDG K TTQESFYKYIKNLLSK-F--EGADYFL--EKIEREDFLRKQRTFDNGSIPHQIHLQEM 420
WP_000428613   358 --DGYAG YIDG K TTQEAFYKYIKNLLSK-F--EGTDYFL--EKIEREDFLRKQRTFDNGSIPHQIHLQEM 420
WP_049523028   357 --DGYAG YIDG K TNQEGFYKYIKNLLSK-I--EGAEYFL--EKIEREDFLRKQRTFDNGSIPHQIHLQEM 419
WP_003107102   326 --NGYAG YING K TSQEDFYKYIKPILSK-L--KGAESLIs--KLEREDFLRKQRTFDNGSIPHQIHLNEL 388
WP_054279288   359 --DGYAG YISG K TSQEAFYKYIKPILET-L--DGAEDFLt--KINREDFLRKQRTFDNGSIPHQIHLGEL 421
WP_049531101   358 --EGYAG YIDS K TTQEAFYKYIKNLLSK-F--DGADYFL--DKIEREDFLRKQRTFDNGSIPHQIHLQEM 420
WP_049538452   358 --DGYAG YVDG K TTQEAFYKYIKNLLSK-F--EGADYFL--EKIEREDFLRKQRTFDNGSIPHQIHLQEM 420
WP_049549711   358 --DGYAG YIDG K VSQDDFYRYIKPILSR-L--EGTDYFL--EKIEREDFLRKQRTFDNGSIPHQIHLQEM 420
WP_007896501   359 --NGYAG YIEG K VSQDEFYRYIKPILSR-L--KGGDEFLa--KIDRDDFLRKQRTFDNGSIPHQIHLKEL 421
EFR44625       311 --NGYAG YIEG K VSQDEFYRYIKPILSR-L--KGGDEFLa--KIDRDDFLRKQRTFDNGSIPHQIHLKEL 373
WP_002897477   357 --DGYAG YIDG K TTQEAFYKYIKNLLSK-F--EGADYFL--DKIEREDFLRKQRTFDNGSIPHQIHLQEM 419
WP_002906454   357 --DGYAG FIDG K TTQEAFYKYIKNLLSK-L--EGADYFL--NKIEREDFLRKQRTFDNGSIPHQIHLQEM 419
WP_009729476   358 --DGYAG YIDG K TTQETFYKYIKNLLSK-I--DGGDYFI--EKIEREDFLRKQRTFDNGSIPHQVHLDEM 420
CQR24647       358 --NGYAG YIDG K TNQEDFYKYIKNLLQK-V--DGGDYFI--EKIEREDFLRKQRTFDNGSIPHQVHLDEM 420
WP_000066813   358 --DGYAG YIDS K TTQEAFYKYIKNLLSK-F--EGADYFL--DKIEREDFLRKQRTFDNGSIPHQIHLQEM 420
WP_009754323   358 --DGYAG YIEG K TTQENFYRFIKKAIEK-I--EGSNYFI--DKIDREDFLRKQRTFDNGSIPHQIHLQEM 420
WP_044674937   357 --DGYAG YIEG K TTQENFYRFIKKAIEK-I--EGSNYFI--DKIDREVFLRKQRSFYNGVIPHQIHLGEL 419
WP_044676715   357 --DGYAG YIEG K TTQENFYRFIKKAIEK-I--EGSNYFI--DKIDREVFLRKQRSFYNSVIPHQIHLQEM 419
WP_044680361   357 --DGYAG YIEG K TTQENFYRFIKKAIEK-I--EGSNYFI--DKIDREDFLRKQRTFDNGSIPHQIHLQEM 419
WP_044681799   357 --DGYAG YIEN G VKQDEFYKYLKGILLQ-I--NGSGDFL--NGSGDFLRKQRTFDNGSIPHQIHLQEM 419
WP_049533112   316 --KGYAG YEES K SKEERLFKHIELLLAKeNv1TTVEHAL1eKNITFASLLPLQRSSRNAVIPYQVHEKEL 403
WP_029090905   361 fyTDYIG YINR K APYDEFYKYVKKCIEK-V dt PEAKQILn-DIFLENFLLKQNSRTNGSVPYQMQLDEM 429
WP_006506696   357 ksKGYYN YIDG G ASQEEFYKFIKPILEK-M-- DGTEELLv--KLNREDLLRKQRSFYNGVIPYQIHLGEL 419
AIT42264       363 --NGYAG YIDG K TSQEDFYKFVKAQLKG-- eENGEYFL-- EAIENENFLRKQRSFYNGVIPYQIHLGEL 425
AKQ21048       357 --NGYAG YIDG G ASQEEFYKFIKPILEK-M-- DGTEELLv--KLNREDLLRKQRSFYNGVIPYQIHLGEL 419
WP_034440723   356 --NGYAG YIDG K TTQENFYKFIEKVMKT-IksDKKDYFL--KLNREDLLRKQRSFYNSVIPHQIHLGEL 420
WP_004636532   363 --DGYAG YIAH A VSQLKFYQYVKKIIQD-I--AGAEYFL--EKIAQENFLRKQRTFDNGVIPHQIHLAEL 427
WP_002364836   314 --DGYAG YIAH A VSQLKFYQYVKKIIQD-I--AGAEYFL--EKIAQENFLRKQRTFDNGVIPHQIHLAEL 378
WP_016631044   100 --NGYAG YIAH A VSQLKFYQYVKKIIQD-I--AGSERFM--EKVDQENFLLKKELNG-I--AGSERFM 162
EMS75795       363 --DGYAG YIAH A VSQLKFYQYVKKIIQD-I--AGAEYFL--EKIAQENFLRKQRTTANGVIPHQVHLTEL 427
WP_002373311   363 --DGYAG YIAH A VSQLKFYQYVKKIIQD-I--AGAEYFL--EKIAQENFLRKQRTFDNGVIPHQIHLAEL 427
WP_002378009   363 --DGYAG YITH A VSQLKFYQYVKKIIQD-I--AGAEYFL--EKIAQENFLRKQRTFDNGVIPHQIHLAEL 427
WP_002407324   363 --DGYAG YITH A VSQLKFYQYVKKIIQD-I--AGAEYFL--EKIAQENFLRKQRTFDNGVIPHQIHLAEL 427
WP_002413717   363 --DGYAG YIAH A VSQLKFYQYVKKIIQD-I--AGAEYFL--EKIAQENFLRKQRTFDNGVIPHQIHLAEL 427
WP_010775580   365 --DGYAG YIAH A VSQLKFYQYVKKIIQD-I--AGAEYFL--EKIAQENFLRKQRTFDNGVIPHQIHLAEL 429
```

```
-continued

WP_010818269    363 --DGYAG YIAH A VSQLKFYQYVKKIIQD-I--AGAEYFL---EKIAQENFLRKQRTFDNGVIPHQIHLAEL    427
WP_010824395    363 --DGYAG YITH A VSQLKFYQYVKKIIQD-I--AGAEYFL---EKIAQENFLRKQRTFDNGVIPHQIHLAEL    427
WP_016622645    363 --DGYAG YIAH A VSQLKFYQYVKKIIQD-I--AGAEYFL---EKIAQENFLRKQRTFDNGVIPHQIHLAEL    427
WP_033625576    363 --DGYAG YIAH A VSQLKFYQYVKKIIQD-I--AGAEYFL---EKIAQENFLRKQRTFDNGVIPHQIHLAEL    427
WP_033789179    363 --DGYAG YIAH A VSQLKFYQYVKKIIQD-I--AGAEYFL---EKIAQENFLRKQRTFDNGVIPHQIHLAEL    427
WP_002310644    361 --NGYAG YIEG H ATQEDFYKFVKKELTG-I--RGSEVFL---TKIEQENFLRKQRTFDNGVIPHQIHLTEL    423
WP_002312694    362 --NGYAG YIEG H ATQEAFYKFVKKELTG-I--RGSEVFL---TKIEQENFLRKQRTFDNGVIPHQIHLTEL    424
WP_002314015    362 --NGYAG YIEG H ATQEDFYKFVKKELTG-I--RGSEVFL---TKIEQENFLRKQRTFDNGVIPHQIHLTEL    424
WP_002320716    362 --NGYAG YIEG H ATQEDFYKFVKKELTG-I--RGSEVFL---TKIEQENFLRKQRTFDNGVIPHQIHLTEL    424
WP_002330729    361 --NGYAG YIEG H ATQEDFYKFVKKELTG-I--RGSEVFL---TKIEQENFLRKQRTFDNGVIPHQIHLTEL    423
WP_002335161    362 --NGYAG YIEG H ATQEDFYKFVKKELTG-I--RGSEVFL---TKIEQENFLRKQRTFDNGVIPHQIHLTEL    424
WP_002345439    362 --NGYAG YIEG H ATQEDFYKFVKKELTG-I--RGSEVFL---TKIEQENFLRKQRTFDNGVIPHQIHLTEL    424
WP_034867970    355 --NGYAG YIKG K TTQEEFYKFVKKELSG-V--VGSEPFL---EKIDQETFLLKQRTYTNGVIPHQVHLIEL    417
WP_047937432    362 --NGYAG YIKG K TTQEEFYKFVKKELTG-I--RGSEVFL---TKIEQENFLRKQRTFDNGVIPHQIHLTEL    424
WP_010720994    355 --NGYAG YIKG K TTQEEFYKFVKKELSG-V--VGSEPFL---EKIDQETFLLKQRTYTNGVIPHQVHLIEL    417
WP_010737004    355 --NGYAG YIKG K TTQEEFYKFVKKELSG-V--VGSEPFL---EKIDQETFLLKQRTYTNGVIPHQVHLIEL    417
WP_034700478    355 --NGYAG YIKG K TTQEEFYKFVKKELSG-V--VGSEPFL---EKIDQETFLLKQRIYDNGVIPHQVHAEEL    417
WP_007209003    359 --NGYAG YIKG K TKEEFYKYLKTTLVQ----ksGYQYFI---EKIEQENFLRKQRTFANGVIPHQIHLVEM    421
WP_023519017    355 --NGYAG YVKG K ATQEDFYKFLRTELAG-L--EESQSIM---EKIDLEIYLLKQRTFDNGVIPHQLHEEEL    417
WP_010770040    358 --SGYAG YVEN S VTQAEFYKYIKKAIEK-V--PGAEYFL---EKIEQETFLDKQRTFNNGVIPHQIHLEEL    422
WP_048604708    354 --DGYAG YIDN S TSQEKFYKYITNLIEK-I--DGAEYFL---KKIENEDFLRKQRTFDNGIIPHQIHLEEL    418
WP_010750235    355 --DGYAG YIDG S TTQADFYKFLKKELTG-V--PGSEPML---AKIDQENFLLKQRTPTNGVIPHQVHLTEF    417
AII16583        396 --NGYAG YIDG G ASQEEFYKFIKPILEK-M--DGTEELLv--KIELESFMLKQNSRTNGAPVPYQMQLDEL    458
WP_029073316    367 kkNNYCN YINH K TPVDEFYKYIKKLIEK-IdaDVKTILn--KIELESFMLKQNSRTNGAPVPYQMQLDEL    435
WP_031589969    367 kkNNYCN YINH K TPVDEFYKYIKKLIEK-IdaDVKTILn--KIELESFMLKQNSRTNGAPVPYQMQLDEL    435
KDA45870        354 -iSGYAG YIDG K VSEEDFYKYTKKTLKG-I--PETEEILq--KIDANNYLRKQRTFDNGAIPHQVHLKEL    417
WP_039099354    360 ------- YVDG K -SKEDFYGDITKALKNnPdhPIVSEIKk-LIELDQFMPKQRTKDNGAIPHQLHQQEL    425
AKP02966        349 ------- QAYDD YINK K --KELYTSLKKFPLKVaLp-TNlAKEAe-EKISKGTYLVKPRNSENGVPYQLNKIEM    415
WP_010991369    363 --HGYAG YIDG - TKQADFYKYMKMTLEN-I--EGADYFI---AKIEKENFLRKQRTFDNGAIPHQLHLEEL    425
WP_033838504    363 --HGYAG YIDG - TKQADFYKYMKMTLEN-I--EGADYFI---AKIEKENFLRKQRTFDNGAIPHQLHLEEL    425
EHN60060        366 --HGYAG YIDG - TKQADFYKYMKMTLEN-V--EGADYFI---AKIEKENFLRKQRTFDNGAIPHQLHLEEL    428
EFR89594        132 ------- YIDG - TKQADFYKYMKMTLEN-I--EGADYFI---AKIEKENFLRKQRTFDNGAIPHQLHLEEL    194
WP_038409211    363 --DGYAG YIDG - TTQEKFYKYMKKMLAN-I--DGADYFI---DQIEEENFLRKQRTFDNGTIPHQLHLEEL    425
AKP02966(2)     349                                                                            415
EFR95520          1     MKKMLAN-I--DGADYFI---DQIEEENFLRKQRTFDNGTIPHQLHLEEL     44
WP_003723650    363 --DGYAG YIEG - TKQEAFYKYMKMLEH-V--EGADYFI---AKIEEENFLRKQRTFDNGAIPHQLHLEEL    425
WP_003727705    363 --DGYAG YIDG - TKQADFYKYMKTLEN-I--EGSDYFI---AKIEEENFLRKQRTFDNGAIPHQLHLEEL    425
WP_003730785    365 --DGYAG YIDG - TKQADFYKYLKTTLEN-V--EGADYFI---TKIEEENFLRKQRTFDNGVIPHQLHLEEL    425
WP_003733029    363 --HGYAG YISG - TKQVDFYKYLKTTLEN-I--EGADYFI---AKIEEENFLRKQRTFDNGAIPHQLHLEEL    425
WP_003739838    363 --DGYAG YIDG - TKQVDFYKYLKTTLEN-I--EGADYFI---AKIEEENFLRKQRTFDNGAIPHQLHLEEL    425
WP_014601172    363 --DGYAG YIDG - TKQVDFYKYLKTTLEN-I--EGADYFI---AKIEEENFLRKQRTFDNGAIPHQLHLEEL    425
WP_023548323    363 --DGYAG YIDG - TKQVDFYKYLKTTLEN-V--EGSDYFI---AKIEEENFLRKQRTFDNGAIPHQLHLEEL    425
WP_031665337    363 --DGYAG YIDG - TKQVDFYKYLKTTLEN-I--EGADYFI---AKIEEENFLRKQRTFDNGAIPHQLHLEEL    425
WP_031669209    363 --HGYAG YISG - TKQVDFYKYMKATLEK-V--EGADYFI---AKIEEENFLRKQRTFDNGAIPHQLHLEEL    425
WP_033920898    363 --DGYAG YIDG - TKQVDFYKYLKTTLEN-I--EGADYFI---AKIEEENFLRKQRTFDNGVIPHQLHLEEL    425
AKI42028        366 --DGYAG YIDG - TKQVDFYKYLKTTLEN-I--EGADYFI---AKIEEENFLRKQRTFDNGAIPHQLHLEEL    428
AKI50529        366 --DGYAG YIDG - TKQVDFYKYLKTTLEN-I--EGADYFI---AKIEEENFLRKQRTFDNGAIPHQLHLEEL    428
EFR83390
WP_046323366    363 --DGYAG YIEG - TKQEAFYKYMKMLEH-V--EGADYFI---NQIEEENFLRKQRTFDNGAIPHQLHLEEL    425
AKE81011        373 --NGYAG YIDG G ASQEEFYKFIKPILEK-M--DGTEELLv--KLNREDLLRKQRTFDNGSIPHQIHLGEL    435
CUO82355        365 kvKGYYN YINR K APVDEFYKFVKKCIEK-VdtPEAKQIlh-DIELENFLLKQNSRTNGSVPYQMQLDEM    433
WP_033162887    366 klHNYLG YIKY D TPVEEFYKYIKGILLAK-VdtDEAREILe--RIDLEKFMLKQNSRTNGSIPYQMQKDEM    434
AGZ01981        390 --NGYAG YIDG G ASQEEFYKFIKPILEK-M--DGTEELLv--KLNREDLLRKQRTFDNGSIPHQIHLGEL    452
```

```
AKA60242       357 --NGYAG YIDG G ASQEEFYKFYKFPILEK-M--DGTEELLv--KLNREDLLRKQRTFDNGSIPHQIHLGEL                                                              419
AKS40380       357 --NGYAG YIDG G ASQEEFYKFYKFPILEK-M--DGTEELLv--KLNREDLLRKQRTFDNGSIPHQIHLGEL                                                              419
4UN5_B         361 --NGYAG YIDG G ASQEEFYKFYKFPILEK-M--DGTEELLv--KLNREDLLRKQRTFDNGSIPHQIHLGEL                                                              423
WP_010922251   420 HAILRRQEDFYPFLKD  KIEKILTFRIPYYVGPL ARG-n--SRFAWMTR--KSEETITPWNF[E]VDKGA                                                                486
WP_039695303   423 HAILRRQGDYYPFLKE--KQD RIEKILTFRIPYYVGPL VRKD--SRFAWAEY--RSDEKITPWNFPDKVIDKEK                                                              489
WP_045635197   420 NAILRRQGEYYPFLKE--NKE KIEKILTFRIPYYVGPL ARGN--RDFAWLTR--NSDEAIRPWNFEEIVDKAS                                                              486
5AXW_A         184 KQLLKVQKAYHQLDQSf1-D TYIDLLETRRTYYEGPG ---Eg-SPFGWKDI--                                                                                  229
WP_009880683   104 HAILRRQEDFYPFLKD--NRE KIEKILTFRIPYYVGPL ARG-n--SRFAWMTR--KSEETITPWNFEEVVDKGA                                                              170
WP_010922251   420 HAILRRQEDFYPFLKD--NRE KIEKILTFRIPYYVGPL ARG-n--SRFAWMTR--KSEETITPWNFEEVVDKGA                                                              486
WP_011054416   420 HAILRRQEDFYPFLKD--NRE KIEKILTFRIPYYVGPL ARG-n--SRFAWMTR--KSEETITPWNFEEVVDKGA                                                              486
WP_011284745   420 HAILRRQEDFYPFLKD--NRE KIEKILTFRIPYYVGPL ARG-n--SRFAWMTR--KSEETITPWNFEEVVDKGA                                                              486
WP_011285506   420 HAILRRQEDFYPFLKD--NRE KIEKILTFRIPYYVGPL ARG-n--SRFAWMTR--KSEETITPWNFEEVVDKGA                                                              486
WP_011527619   420 HAILRRQEDFYPFLKD--NRE KIEKILTFRIPYYVGPL ARG-n--SRFAWMTR--KSEETITPWNFEEVVDKGA                                                              486
WP_012560673   420 HAILRRQEDFYPFLKD--NRE KIEKILTFRIPYYVGPL ARG-n--SRFAWMTR--KSEETITPWNFEEVVDKGA                                                              486
WP_014407541   420 HAILRRQEDFYPFLKD--NRE KIEKILTFRIPYYVGPL ARG-n--SRFAWMTR--KSEETITPWNFEEVVDKGA                                                              486
WP_020905136   420 HAILRRQEDFYPFLKD--NRE KIEKILTFRIPYYVGPL ARG-n--SRFAWMTR--KSEETITPWNFEEVVDKGA                                                              486
WP_023080005   420 HAILRRQEDFYPFLKD--NRE KIEKILTFRIPYYVGPL ARG-n--SRFAWMTR--KSEETITPWNFEEVVDKGA                                                              486
WP_023610282   420 HAILRRQEDFYPFLKD--NRE KIEKILTFRIPYYVGPL ARG-n--SRFAWMTR--KSEETITPWNFEEVVDKGA                                                              486
WP_030125963   420 HAILRRQEDFYPFLKD--NRE KIEKILTFRIPYYVGPL ARG-n--SRFAWMTR--KSEETITPWNFEEVVDKGA                                                              486
WP_030126706   420 HAILRRQEDFYPFLKD--NRE KIEKILTFRIPYYVGPL ARG-n--SRFAWMTR--KSEETITPWNFEEVVDKGA                                                              486
WP_031488318   245 HAILRRQEDFYPFLKD--NRE KIEKILTFRIPYYVGPL ARG-n--SRFAWMTR--KSEETITPWNFEEVVDKGA                                                              311
WP_032460140   420 HAILRRQEDFYPFLKD--NRE KIEKILTFRIPYYVGPL ARG-n--SRFAWMTR--KSEETITPWNFEEVVDKGA                                                              486
WP_032461047   420 HAILRRQEDFYPFLKD--NRE KIEKILTFRIPYYVGPL ARG-n--SRFAWMTR--KSEETITPWNFEEVVDKGA                                                              486
WP_032462016   420 HAILRRQEDFYPFLKD--NRE KIEKILTFRIPYYVGPL ARG-n--SRFAWMTR--KSEETITPWNFEEVVDKGA                                                              486
WP_032462936   420 HAILRRQEDFYPFLKD--NRE KIEKILTFRIPYYVGPL ARG-n--SRFAWMTR--KSEETITPWNFEEVVDKGA                                                              486
WP_032464890   420 HAILRRQEDFYPFLKD--NRE KIEKILTFRIPYYVGPL ARG-n--SRFAWMTR--KSEETITPWNFEEVVDKGA                                                              486
WP_033888930   420 HAILRRQEDFYPFLKD--NRE KIEKILTFRIPYYVGPL ARG-n--SRFAWMTR--KSEETITPWNFEEVVDKGA                                                              486
WP_038431314   420 HAILRRQEDFYPFLKD--NRE KIEKILTFRIPYYVGPL ARG-n--SRFAWMTR--KSEETITPWNFEEVVDKGA                                                              486
WP_038432938   420 HAILRRQEDFYPFLKD--NRE KIEKILTFRIPYYVGPL ARG-n--SRFAWMTR--KSEETITPWNFEEVVDKGA                                                              486
WP_038434062   331 HAILRRQEDFYPFLKD--NRE KIEKILTFRIPYYVGPL ARG-n--SRFAWMTR--KSEETITPWNFEEVVDKGA                                                              397
BAQ51233       
KGE60162       
KGE60856       
WP_002989955   420 HAILRRQEDFYPFLKD--NRE KIEKILTFRIPYYVGPL ARG-n--SRFAWMTR--KSEETITPWNFEEVVDKGA                                                              486
WP_003030002   420 HAILRRQEEHYPFLKE--NQD RIEKILTFRIPYYVGPL ARKG--SRFAWAEY--KADEKITPWNFDDILDKEK                                                              486
WP_003065552   423 HAILRRQGDYYPFLKE--NQD RIEKILTFRIPYYVGPL ARKD--SRFSWAEY--HSDEKITPWNFDKVIDKEK                                                              489
WP_001040076   421 RAIIRRQSEYYPFLKE--NLD RIEKILTFRIPYYVGPL AREK--SDFAWMTR--KTDDSIRPWNFEDLVDKEK                                                              487
WP_001040078   421 RAIIRRQSEYYPFLKE--NQD RIEKILTFRIPYYIGPL AREK--SDFAWMTR--KTDDSIRPWNFEDLVDKEK                                                              487
WP_001040080   421 KAIIRRQSEYYPFLKE--NQD RIEKILTFRIPYYIGPL AREK--SDFAWMTR--KTDDSIRPWNFEDLVDKEK                                                              487
WP_001040081   421 KAIIRRQSEYYPFLKE--NQD RIEKILTFRIPYYIGPL AREK--SDFAWMTR--KTDDSIRPWNFEDLVDKEK                                                              487
WP_001040083   421 KAIIRRQSEYYPFLKE--NQD RIEKILTFRIPYYIGPL AREK--SDFAWMTR--KTDDSIRPWNFEDLVDKEK                                                              487
WP_001040085   421 KAIIRRQSEYYPFLKE--NQD RIEKILTFRIPYYIGPL AREK--SDFAWMTR--KTDDSIRPWNFEDLVDKEK                                                              487
WP_001040087   421 KAIIRRQSEYYPFLKE--NQD RIEKILTFRIPYYIGPL AREK--SDFAWMTR--KTDDSIRPWNFEDLVDKEK                                                              487
WP_001040088   421 KAIIRRQSEYYPFLKE--NQD RIEKILTFRIPYYIGPL AREK--SDFAWMTR--KTDDSIRPWNFEDLVDKEK                                                              487
WP_001040089   421 KAIIRRQSEYYPFLKE--NQD RIEKILTFRIPYYVGPL AREK--SDFAWMTR--KTDDSIRPWNFEDLVDKEK                                                              487
WP_001040090   421 KAIIRRQSEYYPFLKE--NQD RIEKILTFRIPYYVGPL AREK--SDFAWMTR--KTDDSIRPWNFEDLVDKEK                                                              487
WP_001040091   421 KAIIRRQSEYYPFLKE--NQD RIEKILTFRIPYYVGPL ARGN--SDFAWMTR--KTDDSIRPWNFEDLVDKEK                                                              487
WP_001040092   421 KAIIRRQSEYYPFLKE--NQD RIEKILTFRIPYYVGPL AREK--SDFAWMTR--KTDDSIRPWNFEDLVDKEK                                                              487
WP_001040094   421 RAIIRRQSEYYPFLKE--NLD RIEKILTFRIPYYVGPL AREK--SDFAWMTR--KTDDSIRPWNFEDLVDKEK                                                              487
WP_001040095   421 RAIIRRQSEYYPFLKE--NLD RIEKILTFRIPYYVGPL AREK--SDFAWMTR--KTDDSIRPWNFEDLVDKEK                                                              487
WP_001040096   421 RAIIRRQSEYYPFLKE--NLD RIEKILTFRIPYYVGPL AREK--SDFAWMTR--KTDDSIRPWNFEDLVDKEK                                                              487
WP_001040097   421 RAIIRRQSEYYPFLKE--NLD RIEKILTFRIPYYVGPL AREK--SDFAWMTR--KTDDSIRPWNFEDLVDKEK                                                              487
WP_001040098   421 RAIIRRQSEYYPFLKE--NLD RIEKILTFRIPYYVGPL AREK--SDFAWMTR--KTDDSIRPWNFEDLVDKEK                                                              487
```

```
WP_001040099   421 RAIIRRQSEYYPPLKE--NLD RIEKILTFRIPYYVGPL AREK--SDFAWMTR---KTDDSIRPWNFEDLVDKEK 487
WP_001040100   421 RAIIRRQSEYYPPLKE--NLD RIEKILTFRIPYYIGPL AREK--SDFAWMTR---KTDDSIRPWNFEELVDKEA 487
WP_001040104   421 RAIIRRQSEYYPPLKE--NLD RIEKILTFRIPYYIGPL AREK--SDFAWMTR---KTDDSIRPWNFEELVDKEA 487
WP_001040105   421 KAIIRRQSEYYPPLKE--NQD RIEKILTFRIPYYIGPL AREK--SDFAWMTR---KTDDSIRPWNFEDLVDKEK 487
WP_001040106   421 KAIIRRQSEYYPPLKE--NLD RIEKILTFRIPYYIGPL AREK--SDFAWMTR---KTDDSIRPWNFEELVDKEA 487
WP_001040107   421 KAIIRRQSEYYPPLKE--NLD RIEKILTFRIPYYVGPL AREK--SDFAWMTR---KTDDSIRPWNFEELVDKEA 487
WP_001040108   421 KAIIRRQSEYYPPLKE--NLD RIEKILTFRIPYYVGPL AREK--SDFAWMTR---KTDDSIRPWNFEELVDKEA 487
WP_001040109   421 KAIIRRQSEYYPPLKE--NLD RIEKILTFRIPYYVGPL AREK--SDFAWMTR---KTDDSIRPWNFEELVDKEA 487
WP_001040110   421 KAIIRRQSEYYPPLKE--NLD RIEKILTFRIPYYVGPL AREK--SDFAWMTR---KTDDSIRPWNFEELVDKEA 487
WP_015058523   421 RAIIRRQSEYYPPLKE--NQD RIEKILTFRIPYYIGPL ARGN--SDFAWMTR---KTDDSIRPWNFEDLVDKEK 487
WP_017643650   421 RAIIRRQSEYYPPLKE--NLD RIEKILTFRIPYYIGPL AREK--SDFAWMTR---KTDDSIRPWNFEDLVDKEK 487
WP_017647151   421 KAIIRRQSEYYPPLKE--NLD RIEKILTFRIPYYVGPL AREK--SDFAWMTR---KTDDSIRPWNFEELVDKEK 487
WP_017648376   421 KAIIRRQSEYYPPLKE--NLD RIEKILTFRIPYYIGPL AREK--SDFAWMTR---KTDDSIRPWNFEELVDKEA 487
WP_017649527   421 KAIIRRQSEYYPPLKE--NQD RIEKILTFRIPYYVGPL AREK--SDFAWMTR---KTDDSIRPWNFEELVDKEA 487
WP_017771611   421 KAIIRRQSEYYPPLKE--NLD RIEKILTFRIPYYVGPL AREK--SDFAWMTR---KTDDSIRPWNFEELVDKEA 487
WP_017771984   421 KAIIRRQSEYYPPLKE--NQD RIEKILTFRIPYYVGPL AREK--SDFAWMTR---KTDDSIRPWNFEELVDKEA 487
CFQ25032       421 KAIIRRQSEYYPPLKE--NLD RIEKILTFRIPYYVGPL AREK--SDFAWMTR---KTDDSIRPWNFEELVDKEA 487
CFV16040       421 KAIIRRQSEYYPPLKE--NQD RIEKILTFRIPYYIGPL AREK--SDFAWMTR---KTDDSIRPWNFEDLVDKEK 487
KLJ37842       421 KAIIRRQSEYYPPLKE--NQD RIEKILTFRIPYYIGPL AREK--SDFAWMTR---KTDDSIRPWNFEDLVDKEK 487
KLJ72361       421 RAIIRRQSEYYPPLKE--NQD KIEKILTFRIPYYIGPL AREK--SDFAWMTR---KTDDSIRPWNFEELVDKEK 487
KLL20707       421 KAIIRRQSEYYPPLKE--NLD KIEKILTFRIPYYVGPL AREK--SDFAWMTR---KTDDSIRPWNFEDLVDKEA 487
KLL42645       421 KAIIRRQSEYYPPLKE--NLD RIEKILTFRIPYYVGPL AREK--SDFAWMTR---KTDDSIRPWNFEELVDKEA 487
WP_047207273   421 KAIIRRQSEYYPPLKE--NQD RIEKILTFRIPYYIGPL AREK--SDFAWMTR---KTDDSIRPWNFEDLVDKEK 487
WP_047209694   421 RAIIRRQSEYYPPLKE--NQD RIEKILTFRIPYYVGPL AREK--SDFAWMTR---KTDDSIRPWNFEDLVDKEK 487
WP_049516684   421 KAIIRRQSEYYPPLKE--NQD RIEKILTFRIPYYIGPL AREK--SDFAWMTR---KTDDSIRPWNFEELVDKEK 487
WP_050198062   421 KAIIRRQSEYYPPLKE--NLD RIEKILTFRIPYYVGPL AREK--SDFAWMTR---KTDDSIRPWNFEDLVDKEK 487
WP_050201642   421 RAIIRRQSEYYPPLKE--NLD RIEKILTFRIPYYVGPL AREK--SDFAWMTR---KTDDSIRPWNFEELVDKEA 487
WP_050204027   421 KAIIRRQSEYYPPLKE--NLD RIEKILTFRIPYYVGPL AREK--SDFAWMTR---KTDDSIRPWNFEELVDKEA 487
WP_050881965   421 KAIIRRQSEYYPPLKE--NLD RIEKILTFRIPYYVGPL AREK--SDFAWMTR---KTDDSIRPWNFEDLVDKEK 487
WP_050886065   421 KDIIRRQSEYYPPLKE--NQD KIEKILTFRIPYYIGPL AREK--SDFAWMTR---KTDDSIRPWNFEELVDKEK 487
AHN30376       421 KAIIRRQSEYYPPLKE--NQD RIEKILTFRIPYYVGPL ARGN--SDFAWMTR---KTDDSIRPWNFEELVDKEA 487
EA078426       421 RAIIRRQSEYYPPLKE--NLD RIEKILTFRIPYYVGPL AREK--SDFAWMTR---KTDDSIRPWNFEELVDKEA 487
CCW42055       421 KAIIRRQSEYYPPLKE--NQD RIEKILTFRIPYYVGPL AREK--SDFAWMTR---KADEKITPWNFDDILDKEK 487
WP_003041502   420 HAILRRQGEHYPPLKE--NQD KIEKILTFRIPYYVGPL ARKG--SRFAWAEY--KADEKITPWNFDDILDKEK 486
WP_037593752   421 HAILRRQGEHYPPLKE--NQD KIEKILTFRIPYYVGPL ARKG--SRFAWAEY--KADEKITPWNFDDILDKEK 487
WP_049516684   420 HAILRRQGEHYPPLKE--NRE KIEKILTFRIPYYVGPL ARKG--SRFAWAEY--KADEKITPWNFDDILDKEK 486
GAD46167       420 HAILRRQGEHYPPLKE--NRE KIEKILTFRIPYYVGPL ARKG--SRFAWAEY--KADEKITPWNFDDILDKEK 486
WP_018363470   421 HAILRRQEFYPPLKE--NQE EIEKILTFRIPYYVGPL ARKD--SRFAWAEY--RSDEKITPWNFDKVIDKEK 487
WP_003043819   430 HAILRRQGEHYPPLKE--NRE KIEKILTFRIPYYVGPL ARG-n-SRFAWLTR--KSEEAITPWNFEEVVDKGA 496
WP_006269658   420 HAILRRQGEHYPPLKE--NQD KIEKILTFRIPYYVGPL ARKG--SRFAWAEY--KADEKITPWNFDDILDKEK 486
WP_048800889   420 HAILRRQGEHYPPLKE--NRE KIEKILTFRIPYYVGPL VRKG--SRFAWAEY--KSEETITPWNFEEVVDKGA 486
WP_012767106   420 HAILRRQEDFYPPLKD--NRE KIEKILTFRIPYYVGPL ARG-n-SRFAWMTR--KSEETITPWNFEEVVDKGA 486
WP_014612333   420 HAILRRQEDFYPPLKD--NRE KIEKILTFRIPYYVGPL ARG-n-SRFAWMTR--KSEETITPWNFEEVVDKGA 486
WP_015017095   420 HAILRRQGEHYPPLKE--NQD KIEKILTFRIPYYVGPL ARG-n-SRFAWMTR--KADEKITPWNFDDILDKEK 486
WP_015057649   420 HAILRRQEDFYPPLKD--NRE KIEKILTFRIPYYVGPL ARG-n-SRFAWMTR--KSEETITPWNFEEVVDKGA 486
WP_048327215   420 HAILRRQEVEYPPLKD--NRK KIESLLTFRIPYYVGPL ARG-n-SRFAWVKR--KPDGAIRPWNFEEIVDEEA 486
WP_049519324   420 HAILRRQEVEYPPLKE--NRK KIESLLTFRIPYYVGPL ARG-h-SRFAWVKR--KPDGAIRPWNFEEIVDEEA 486
WP_012515931   420 HAILRRQEVEYPPLKE--NRK KIESLLTFRIPYYVGPL ARG-n-SRFAWVKR--KFDGAIRPWNFEEIVDEEA 486
WP_021320964   421 HAILRRQEDFYPPLKE--NRK KIESLLTFRIPYYVGPL ARG-h-SRFAWVKR--KFDGAIRPWNFEEIVDEEA 487
WP_037581760   420 HAILRRQGEHYAFLKE--NQA KIEKILTFRIPYYVGPL ARKN--SRFAWAKY--HSDEPITPWNFDEVVDKEK 486
WP_004232481   421 RTILRRQGDYYPPLKE--NQA KIEKILTFRIPYYVGPL VRKD--SRFAWAEY--RSDEKITPWNFDKVIDKEK 487
WP_009854540   420 HAILRRQEVEYPPLKE--KQD RIEKILTFRIPYYVGPL ARKN--SRFAWAEY--HSDEKITPWNFDEIIDKEK 486
WP_012962174   487 HAILRRQGEHYAFLKE--NQA KIEKILTFRIPYYVGPL VRKD--SRFAWAEY--RSDEKITPWNFDKVIDKEK 487
WP_039695303   423 HAILRRQGDYYPPLKE--KQD RIEKILTFRIPYYVGPL VRKD--SRFAWAEY--RSDEKITPWNFDKVIDKEK 489
```

```
WP_014334983   420 HSILRRQGDYYPPLKE--NQA KIEKILTFRIPYYVGPL ARKD--SRFAWANY---HSDEPITPWNFDEVVDKEK 486
WP_003092269   420 KAIIRRQEKFYPPLKE--NQK KIEKLFTFKIPYYVGPL ANG-q-SSFAWLKR---QSNESITPWNFEEVDQEA 486
AHY15608       420 KAIIRRQEKFYPPLKE--NQK KIEKLFTFKIPYYVGPL ANG-q-SSFAWLKR---QSNESITPWNFEEVDQEA 486
AHY17476       420 KAIIRRQEKFYPPLKE--NQK KIEKLFTFKIPYYVGPL ANG-q-SSFAWLKR---QSNESITPWNFEEVDQEA 486
ESR09100       ---------------------------------------------------------------------------
AGM98575       420 RAIIRRQEKFYPPLKE--NQK KIEKLFTFKIPYYVGPL ANG-q-SSFAWLKR---QSNESITPWNFEEVDQEA 486
ALF27331       420 RAIIRRQAEFYPPLAD--NQD KIEKILTFRIPYYIGPL ARGK--SDFSWLSR---KSADKITPWNFDEIVDKES 486
WP_018372492   433 QAIILNQSKYYPPLAE--NKE KIEKILTFRIPYYVGPL ARGN--SSFAWLQR---KSDEAIRPWNFEQVDMET 499
WP_045618028   421 NAIIRRQGEHYPPLQE--NKE KIEKILTFRIPYYVGPL ARGN--RDFAWLTR---NSDQAIRPWNFEEIVDKAR 487
WP_045635197   420 RAIIRRQAEFYPPLAD--NKE KIEKILTFRIPYYVGPL ARGN--RDFAWLTR---NSDEARPWNFEEIVDKAS 486
WP_002263549   420 RAIIRRQAEFYPPLAD--NQD KIEKILTFRIPYYVGPL ARGK--SDFAWLSR---KSADKITPWNFDEIVDKES 486
WP_002263887   420 RAIIRRQAEFYPPLAD--NQD RIEKILTFRIPYYVGPL ARGK--SDFAWLSR---KSADKITPWNFDEIVDKES 486
WP_002264920   420 HAILRRQGDYYPPLKE--NQD RIEKILTFRIPYYVGPL ARGK--SDFAWLSR---KSADKITPWNFDEIVDKES 486
WP_002269043   420 RAIIRRQAEFYPPLAD--NQD RIEKILTFRIPYYVGPL ARGK--SDFAWLSR---KSADKITPWNFDEIVDKES 486
WP_002269448   420 RAIIRRQAEFYPPLAD--NQD RIEKILTFRIPYYVGPL ARGK--SDFAWLSR---KSADKITPWNFDEIVDKES 486
WP_002271977   420 RAIIRRQAEFYPPLAD--NQD RIEKILTFRIPYYVGPL ARGK--SDFAWLSR---KSADKITPWNFDEIVDKES 486
WP_002272766   420 RAIIRRQAEFYPPLAD--NQD RIEKILTFRIPYYVGPL ARGK--SDFAWLSR---KSADKITPWNFDEIVDKES 486
WP_002273241   420 RAIIRRQAEFYPPLAD--NQD RIEKILTFRIPYYVGPL ARGK--SDFAWLSR---KSADKITPWNFDEIVDKES 486
WP_002275430   420 RAIIRRQAEFYPPLAD--NQD RIEKILTFRIPYYVGPL ARGK--SDFAWLSR---KSADKITPWNFDEIVDKES 486
WP_002276448   420 RAIIRRQAEFYPPLAD--NQD RIEKILTFRIPYYVGPL ARGK--SDFAWLSR---KSADKITPWNFDEIVDKES 486
WP_002777050   420 HAILRRQGDYYPPLKE--NQD RIEKILTFRIPYYVGPL ARKN--SRFAWAEY---HSDEAVMPWNFDQVIDKES 486
WP_002273364   420 RAIIRRQAEFYPPLAD--NQD RIEKILTFRIPYYVGPL ARGK--SDFAWLSR---KSADKITPWNFDEIVDKES 486
WP_002279025   420 RAIIRRQSEFYPPLAD--NQD RIEKILTFRIPYYVGPL ARGK--SDFAWLSR---KSADKITPWNFDEIVDKES 486
WP_002279859   420 RAIIRRQAEFYPPLAD--NQD RIEKILTFRIPYYVGPL ARGK--SDFAWLSR---KSADKITPWNFDEIVDKES 486
WP_002280230   420 RAIIRRQAEFYPPLAD--NQD RIEKILTFRIPYYVGPL ARGK--SDFAWLSR---KSADKITPWNFDEIVDKES 486
WP_002281696   420 RAIIRRQAEFYPPLAD--NQD RIEKILTFRIPYYVGPL ARGK--SDFAWLSR---KSADKITPWNFDEIVDKES 486
WP_002282247   420 HAILRRQGDYYPPLKE--NQD RIEKILTFRIPYYVGPL ARKN--SRFAWAEY---HSDEAVTPWNFDQVIDKES 486
WP_002282906   420 RAIIRRQAEFYPPLAD--NQD RIEKILTFRIPYYVGPL ARGK--SDFAWLSR---KSADKITPWNFDEIVDKES 486
WP_002283846   420 RAIIRRQAEFYPPLAD--NQD RIEKILTFRIPYYVGPL ARGK--SDFAWLSR---KSADKITPWNFDEIVDKES 486
WP_002872255   420 RAIIRRQAEFYPPLAD--NQD RIEKILTFRIPYYVGPL ARGK--SDFAWLSR---KSADKITPWNFDEIVDKES 486
WP_002888990   420 RAIIRRQAEFYPPLAD--NQD RIEKILTFRIPYYVGPL ASGK--SDFAWLSR---KSADKITPWNFDEIVDKES 486
WP_002289641   420 RAIIRRQAEFYPPLAD--NQD RIEKILTFRIPYYVGPL ARGK--SDFAWLSR---KSADKITPWNFDEIVDKES 486
WP_002290427   420 RAIIRRQAEFYPPLAD--NQD RIEKILTFRIPYYVGPL ARGK--SDFAWLSR---KSADKITPWNFDEIVDKES 486
WP_002295753   420 RAIIRRQAEFYPPLAD--NQD RIEKILTFRIPYYVGPL ARGK--SDFAWLSR---KSADKITPWNFDEIVDKES 486
WP_002296423   420 RAIIRRQAEFYPPLAD--NQD RIEKILTFRIPYYVGPL ARGK--SDFAWLSR---KSADKITPWNFDEIVDKES 486
WP_002304487   430 HAILRRQGEHYPPLKE--NQD RIEKLLTFRIPYYVGPL VRKG--SRFAWAEY---KADEKITPWNFDDILDKEK 496
WP_002305844   420 RAIIRRQAEFYPPLAD--NQD RIEKLLTFRIPYYVGPL ARGK--SDFAWLSR---KSADKITPWNFDEIVDKES 486
WP_002307203   420 RAIIRRQAEFYPPLAD--NQD KIEKILTFRIPYYVGPL ARGK--SDFAWLSR---KSADKITPWNFDEIVDKES 486
WP_002310390   420 RAIIRRQAEFYPPLAD--NQD RIEKILTFRIPYYVGPL ARGK--SDFAWLSR---KSADKITPWNFDEIVDKES 486
WP_002352408   420 RAIIRRQAEFYPPLAD--NQD RIEKILTFRIPYYVGPL ARGK--SDFAWLSR---KSADKITPWNFDEIVDKES 486
WP_012997688   420 RAIIRRQAEFYPPLAD--NQD RIEKILTFRIPYYVGPL ARGK--SDFAWLSR---KSADKITPWNFDEIVDKES 486
WP_014677909   420 RAIIRRQAEFYPPLAD--NQD RIEKILTFRIPYYVGPL ARGK--SDFAWLSR---KSADKITPWNFDEIVDKES 486
WP_019312892   420 RAIIRRQAEFYPPLAD--NQD RIEKILTFRIPYYVGPL ARGK--SDFAWLSR---KSADKITPWNFDEIVDKES 486
WP_019313659   420 RAIIRRQAEFYPPLAD--NQD RIEKILTFRIPYYVGPL ARGK--SDFAWLSR---KSADKITPWNFDEIVDKES 486
WP_019314093   420 RAIIRRQAEFYPPLAD--NQD RIEKILTFRIPYYVGPL ARGK--SDFAWLSR---KSADKITPWNFDEIVDKES 486
WP_019315370   420 HAILRRQGDYYPPLKE--NQD RIEKILTFRIPYYVGPL ARKN--SRFAWAEY---HSDEAVTPWNFDQVIDKES 486
WP_019803776   420 RAIIRRQAEFYPPLAD--NQD RIEKILTFRIPYYVGPL ARGK--SDFAWLSR---KSADKITPWNFDEIVDKES 486
WP_019805234   420 RAIIRRQAEFYPPLAD--NQD RIEKILTFRIPYYVGPL ARGK--SDFAWLSR---KSADKITPWNFDEIVDKES 486
WP_024783594   420 RAIIRRQAEFYPPLAD--NQD RIEKILTFRIPYYVGPL ARGK--SDFAWLSR---KSADKITPWNFDEIVDKES 486
WP_024784288   420 HAILRRQGDYYPPLKE--NQD RIEKILTFRIPYYVGPL ARKN--SRFAWAEY---HSDEAVTPWNFDQVIDKES 486
WP_024784666   420 RAIIRRQAEFYPPLAD--NQD RIEKILTFRIPYYVGPL ARGK--SDFAWLSR---KSADKITPWNFDEIVDKES 486
WP_024784894   420 RAIIRRQAEFYPPLAD--NQD RIEKILTFRIPYYVGPL ASGK--SDFAWLSR---KSADKITPWNFDEIVDKES 486
WP_024786433   420 HAILRRQGDYYPPLKE--NQD RIEKILTFRIPYYVGPL ARKN--SRFAWAEY---HSDEAVTPWNFDQVIDKES 486
```

```
                      -continued
WP_049473442  420  RAIIRRQAEFYPPLAD--NQD RIEKILTFRIPYYVGPL ARGK-SDFAWlSR---KSADKITPWNFDEIVDKES  486
WP_049474547  420  RAIIRRQAEFYPPLAD--NQD RIEKILTFRIPYYVGPL ASGK-SDFAWlSR---KSADKITPWNFDEIVDKES  486
EMC03581      413  RAIIRRQAEFYPPLAD--NQD RIEKILTFRIPYYVGPL ARGK-SDFAWlSR---KSADKITPWNFDEIVDKES  479
WP_000428612  421  NAILRRQGEHYPFLKE--NKE KIEKILTFRIPYYVGPL ARGN-RDFAWLTR---NSDQAIRPWNFEEIVDKAS  487
WP_000428613  421  NAILRRQGEHYPFLKD--NKE KIEKILTFRIPYYVGPL ARGN-RDFAWLTR---NSDEAIRPWNFEEIVDKAS  487
WP_049523028  420  NAILRHQGEYYPFLKE--NKD KIEQILTFRIPYYVGPL ARGN-SDFAWLSR---NSDEAIRPWNFEEMVDKSS  486
WP_003107102  389  KSIIRRQEKYPFLKD--KQV RIEKIFTFRIPYFVGPL ANG-n-SSFAWVKR---RSNESITPWNFEEVVEQEA  455
WP_054279288  422  QAILERQQAYYPFLKD--NQE KIEKITFRIPYYIGPL ARG-n-SRFAWLTR---TSDQKITPWNFDEMVDQEA  488
WP_049531101  421  NAILRRQGEHYPFLKE--NRE KIEKILTFRIPYYVGPL ARGN-RDFAWLTR---NSDQAIRPWNFEEIVDKAS  487
WP_049538452  421  NAILRRQGEHYPFLKE--NKE KIEKILTFRIPYYVGPL ARGN-RDFAWLTR---NSDQAIRPWNFEEIVDKAS  487
WP_049549711  421  NAILRRQGEHYPFLKE--NRE KIEKILTFRIPYYVGPL ARGN-RDFAWLTR---NSDQAIRPWNFEEIVDKAS  487
WP_007896501  422  HAILRRQEKYPFLAE--QKE KIEQLLCFRIPYYVGPL AKGGn-SSFAWLKR---RSDEPITPWNFKDVVDEEA  489
EFR44625      374  HAILRRQEKYPFLAE--QKE KIEQLLCFRIPYYVGPL AKGGn-SSFAWLKR---RSDEPITPWNFKDVVDEEA  441
WP_002897477  420  NAILRRQGEHYPFLKE--NRE KIEKILTFRIPYYVGPL ARDN-RDFSWLTR---NSDEPIRPWNFEEVVDKAR  486
WP_002906454  420  NAILRRQGEHYLFLKE--NRE KIEKILAFRIPYYVGPL ARGN-RDFAWLTR---NSDQAIRPWNFEEIVDKAS  486
WP_009729476  421  NAILRRQGEHYPFLKE--NKE KIEKILTFRIPYYVGPL ARGN-RDFAWLTR---NSDQAIRPWNFEEIVDKAS  487
CQR24647      421  KAILRRQGEFYPFLKE--NAE KIQQILTFKIPYYVGPL ARGN-SRFAWASY---NSNEKMTPWNFDNVIDKTS  487
WP_000066813  421  NAILRRQGEHYPFLQE--NKE KIEKILTFRIPYYVGPL ARGN-GDFAWLTR---NSDQAIRPWNFEEIVDQAS  487
WP_009754323  421  NAILRRQGEHYPLLKE--NKE KIEKILTFRIPYYVGPL ARGN-RDFAWLTR---NSDQAIRPWNFEEIVDKAS  487
WP_044674937  420  HAILRRQGEHYPFLVE--NQD KIEKILTFRIPYYVGPL ARGN-SEFAWLNR---KSDEKIRPWNFDEMVDKET  486
WP_044676715  420  HAILRRQAEFYPFLVE--NQD KIEKILTFRIPYYVGPL ARGK-SEFAWLNR---KSDEKIRPWNFDEMVDKET  486
WP_044680361  420  HAILRRQAEFYPFLVE--NQD KIEKILTFRIPYYVGPL ARGK-SEFAWLNR---KSDEKIRPWNFDEMVDKET  486
WP_044681799  420  HAILRRQAEFYPFLVE--NQD KIEKILTFRIPYYVGPL ARKG-SRFAWAEY---KADEKITPWNFDDILDKEK  486
WP_049533112  420  HAILRRQGEHYPFLKE--NQD KIEKILTFRIPYYVGPL ADQKd-SEFAWMVR---KQAGKITPFNFEEMVDIDA  486
WP_029090905  404  VAILENQATYYPELLE--QKD NIHKLLTFRIPYYVGPL ETSEh----AWIKRlegKENQRILPWNYQDIVDVDA  471
WP_006506696  430  IKIIDNAEYYPILKE--KRE QLLSLLTFRIPYFGPL ARG-n-SRFAWMTR---KSEETITPWNFEEVVDKGA  498
AIT42264      420  TAVLDQQREKHYSPLKE--NRD KIISLLTFRIPYYVGPL ARGE-SRFAWMTR---sNSEEKIKPWNEDKIVDIDK  486
AKQ21048      426  HAILRRQEDFYPFLKD--NRE KIEKILTFRIPYYVGPL ARG-n-SRFAWMTR---KSEETITPWNFEEVVDKGA  493
WP_004636532  420  QAILDRQSQYYPFLAE--NRD KIESLVTFRIPYYVGPL TVSDq-SEFAWMER---QSDEPIRPWNFDEIVNKER  486
WP_002378009  421  QAIHRQAAYYPFLKE--NQE KIEQLVTFRIPYYVGPL SKGDA-STFAWLKR---QSEEPIRPWNLQETVDLDQ  488
WP_002407324  428  QAIHRQAAYYPFLKE--NQE KIEQLVTFRIPYYVGPL SKGDA-NTFAWLKR---QSEEPIRPWNLQETVDLDQ  495
WP_002413717  428  QAIHRQAAYYPFLKE--NQE KIEQLVTFRIPYYVGPL SKGDA-STFAWLKR---QSEEPIRPWNLQETVDLDQ  495
WP_016631044  379  QAIHRQAAYYPFLKE--NQE KIEQLVTFRIPYYVGPL SKGDa-STFAWLKR---QSEEPIRPWNLQETVDLDQ  446
EMS75795      163  KAIIERQKPYYPSLEE--ARD KMIRLLTFRIPYYVGPL AQGEt-SSFAWLER---KTPEKVTPWNLATEVIDYSA  231
WP_010775580  430  QAIHRQAAYYPFLKE--NQK KIEQLVTFRIPYYVGPL SKGDa-STFAWLKR---QSEEPIRPWNLQETVDLDQ  497
WP_010818269  428  QAIHRQAAYYPFLKE--NQE KIEQLVTFRIPYYVGPL SKGDA-STFAWLKR---QSEEPIRPWNLQETVDLDQ  495
WP_010824395  428  QAIHRQAAYYPFLKE--NQE KIEQLVTFRIPYYVGPL SKGDA-STFAWLKR---QSEEPIRPWNLQETVDLDQ  495
WP_016222645  428  QAIHRQAAYYPFLKE--NQE KIEQLVTFRIPYYVGPL SKGDA-STFAWLKR---QSEEPIRPWNLQETVDLDQ  495
WP_033624816  428  QAIHRQAAYYPFLKE--NQK KIEQLVTFRIPYYVGPL SKGDA-STFAWLKR---QSEEPIRPWNLQETVDLDQ  495
WP_033625576  428  QAIHRQAAYYPFLKE--NQE KIEQLVTFRIPYYVGPL SKGDa-STFAWLKR---QNEKPIRPWNLQETVDLDQ  495
WP_033789179  428  QAIHRQAAYYPFLKE--EQE KIESLLTFKIPYYVGPL SKGDa-STFAWLKR---QSEEPIRPWNLPEIVDMEG  495
WP_002310644  424  RAIIANQKKHYPFLKE--EQE KLESLLTFKIPYYVGPL AKKQen-SPFAWLIR---KSEEKIKPWNLPEIVDMEG  492
WP_002312694  425  RAIIANQKKHYPFLKE--EQE KLESLLTFKIPYYVGPL AKKQen-SPFAWLIR---KSEEKIKPWNLPEIVDMEG  493
WP_002314015  425  RAIIANQKKHYPFLKE--EQE KLESLLTFKIPYYVGPL AKKQen-SPFAWLIR---KSEEKIKPWNLPEIVDMEG  493
WP_002320716  425  RAIIANQKKHYPFLKE--EQE KLESLLTFKIPYYVGPL AKKQen-SPFAWLIR---KSEEKIKPWNLPEIVDMEG  493
WP_002330729  424  RAIIANQKKHYPFLKE--EQE KLESLLTFKIPYYVGPL AKKQen-SPFAWLIR---KSEEKIKPWNLPEIVDMEG  492
WP_002335161  425  RAIIANQKKHYPFLKE--EQE KLESLLTFKIPYYVGPL AKKQen-SPFAWLIR---KSEEKIKPWNLPEIVDMEG  493
WP_002345439  425  RAIIANQKKHYPFLKE--AGP KIIALPKFRIPYYVGPL AKKQeaSSFAWIER---KTAEKINPWNFSEVVDIEK  493
WP_034867970  418  KAIIDQQKQHYPFLEE--AGP KIIALPKFRIPYYVGPL AKKQeaSSFAWIER---KTAEKINPWNFSEVVDIEK  486
WP_047937432  425  RAIIANQKKHYPFLKE--EQE KLESLLTFKIPYYVGPL AKKQen-SPFAWLIR---KSEEKIKPWNLPEIVDMEG  493
```

```
                        -continued

WP_010720994 418 KAIIDQQKQHYPPLEE--AGP KIIALFKFRIPYYVGPL AKEQeaSSFAWIER---KTAEKINPWNFSEVDIEK       486
WP_010737004 418 KAIIDQQKQHYPPLEE--AGP KIIALFKFRIPYYVGPL AKEQeaSSFAWIER---KTAEKINPWNFSEVDIEK       486
WP_034700478 418 KAIIDQQKQHYPPLEE--AGP KIIALFKFRIPYYVGPL AKEQeaSSFAWIER---KTAEKINPWNFSEVDIEK       486
WP_007209003 422 RAILRKQEKYYSFIKE--NHE KIEQIFKVRIPYYVGPL AKHNeqSRFAWNIR---KSDEPIRPWNMNDVVDENA       490
WP_023519017 418 REIMDRQKRFYPPLKG--AQG KIEKLLTFRIPYYVGPL AQEGq--SPFAWLER---KSPSQITPWNFAEVVDKEN       485
WP_010770040 423 EAIQKQATYYPPFLAD--NKE EMKQLVTFRIPYYVGPL ADGN---SPFAWLER---ISSEPIRPGNLAEVVDIKK      489
WP_048604708 419 KAILHHQAMYYPPFLQE--KFS NFVDLLTFRIPYYVGPL ANGN---SRFSWLSR---KSDEPIRPWNLAEVVDLSK    485
WP_010750235 418 KAIIDQQKQYYPPFIEK--SKE KMIQLLTFRIPYYVGPL AQDKet-SSFAWLER---KTTEKIKPWNAKDVIDYGA    486
AII16583      459 HAILRRQEDFYPPLKD--NRE KIEKLLTFRIPYYVGPL ARG-n--SRFAWMTR---KSEETITPWNFEEVVDKGA    525
WP_029073316 436 NKILENQSVYYSDLKD--NED KIRSLLTFRIPYYFGPL ITKDr--QFDWIIKegKENERILPWNANEIVDVDK      506
WP_031589969 436 NKILENQSVYYSDLKD--NED KIRSLLTFRIPYYFGPL ITKDr--QFDWIIKegKENERILPWNANEIVDVDK      506
KDA45870      418 VAIVENQGYYPPLKE--NKD KFEKILNFRIPYYVGPL ARGN---SKFAWLTR---a-GEGKITPYNFDEMIDKET     484
WP_039099354 426 DRIIENQQOYYPWLAE--INPN KLDELVAFRVPYYVGPL QQQSsdAKFAWMIR--KAEBGQITPWNFDDKVDRQA     509
AKP02966      416 EKIIDNQSQYYPPLKE--NKE KLLSIlsFRIPYYVGPL -QSSekNPFAWMER--KSNGHARPWNFDEIVDREK     483
WP_010991369 426 EAILHQQAKYYPPLKE--NYD KIKSLVTFRIPYFVGPL ANGQ---SEFAWLTR---KADGEIRPWNIEEKVDFGK    492
WP_033838504 426 EAILHQQAKYYPPLKE--NYD KIKSLVTFRIPYFVGPL ANGQ---SEFAWLTR---KADGEIRPWNIEEKVDFGK    492
EHN60060      429 EAILHQQAKYYPPLKE--NYD KIKSLVTFRIPYFVGPL ANGQ---SEFAWLTR---KADGEIRPWNIEEKVDFGK    495
EFR89594      195 EAILHQQAKYYPPLKE--NYD KIKSLVTFRIPYFVGPL ANGQ---SDFAWLTR---KADGEIRPWNIEEKVDFGK    261
WP_038409211 426 EAILHQQAKYYPPLRK--DYE KIRSLVTFRIPYFIGPL ANGQ---SDFAWLTR---KADGEIRPWNIEEKVDFGK    492
EFR95520       45 EAILHQQAKYYPPLRK--DYE KIRSLVTFRIPYFIGPL ANGQ---SDFAWLTR---KADGEIRPWNIEEKVDFGK    111
WP_003723650 426 EAILHQQAKYYPPLKE--DYD KIKSLVTFRIPYFVGPL ANGQ---SEFAWLTR---KADGEIRPWNIEEKVDFGK    492
WP_003727705 426 EAILHQQAKYYPPLRE--GYD KIKSLVTFRIPYFVGPL ANGQ---SEFAWLTR---KDDGEIRPWNIEEKVDFGK    492
WP_003730785 426 EAILHQQAKYYPPLRE--DYE KIKSLVTFRIPYFVGPL ANGQ---SEFAWLTR---KADGEIRPWNIEEKVDFGK    492
WP_003733029 426 EAILHQQAKYYPPLKE--DYE KIKSLVTFRIPYFVGPL AKGQ---SDFAWLTR---KADGEIRPWNIEEKVDFGK    492
WP_003739838 429 EAILHQQAKYYPPLKE--AYD KIKSLVTFRIPYFVGPL ANGQ---SEFAWLTR---KADGEIRPWNIEEKVDFGK    495
WP_014601172 426 EAILHQQAKYYPPLRE--DYE KIKSLVTFRIPYFVGPL AKGQ---SDFAWLTR---KADGEIRPWNIEEKVDFGK    492
WP_023548323 426 EAILHQQAKYYTFLKE--DYD KIKSLVTFRIPYFVGPL AKGQ---SEFAWLTR---KADGEIRPWNIEEKVDFGK    492
WP_031665337 426 EAILHQQAKYYPPLRE--DYE KIKSLVTFRIPYFVGPL ANGQ---SEFAWLTR---KADGEIRPWNIEEKVDFGK    492
WP_031669209 426 EAILHQQAKYYPPLRE--DYE KIKSLVTFRIPYFVGPL AKGQ---SEFAWLTR---KADGEIRPWNIEEKVDFGK    492
WP_033920898 426 EAILHQQAKYYPPLRE--DYE KIKSLVTFRIPYFVGPL AKGQ---SEFAWLTR---KADGEIRPWNIEEKVDFGK    492
AKI42028      426 EAILHQQAKYYPPLRE--DYE KIKSLVTFRIPYFVGPL AKGQ---SEFAWLTR---KADGEIRPWNIEEKVDFGK    492
AKI50529      429 EAILHQQAKYYPPLRE--DYE KIKSLVTFRIPYFVGPL AKGQ---SEFAWLTR---KADGEIRPWNIEEKVDFGK    495
EFR83390      ---  ----------------- ----------------- ----------------------------------      ---
WP_046323366 426 EAILHQQAKYYPPLKV--DYE KIKSLVTFRIPYFVGPL ANGQ---SEFSWLTR---KADGEIRPWNIEEKVDFGK    492
AKE81011      436 HAILRRQEDFYPPLKD--NRE KIEKLLTFRIPYYVGPL ARG-n--SRFAWMTR---KSEETITPWNFEEVVDKGA    502
CUO82355      434 IKILDNQAKYYPVLKE--KRE QLLSILTFRIPYYFGPL ETSEh-----AWIKRlegKENQRILPWNYQDTVDVDA    502
WP_033162887 435 IQIDNQSVYYPQLKE--NRD KLISILEFRIPYYVGPL AHSE---FAWIKKfedKQKERILPWNKFQIVDIDA      503
AGZ01981      453 --KEWYEMLMGHCTYFFEELRSVKYAYNADLYNALNDLNNLVITR---DENEKLeYYE--KFQIIENVFK--QKK-KPTL 519
AKA60242      420 HAILRRQEDFYPPLKD--NRE KIEKLLTFRIPYYVGPL ARG-n--SRFAWMTR---KSEETITPWNFEEVVDKGA    486
AKS40380      420 HAILRRQEDFYPPLKD--NRE KIEKLLTFRIPYYVGPL ARG-n--SRFAWMTR---KSEETITPWNFEEVVDKGA    486
4UN5_B        424 HAILRRQEDFYPPLKD--NRE KIEKLLTFRIPYYVGPL ARG-n--SRFAWMTR---KSEETITPWNFEEVVDKGA    490
WP_010922251 487 SAQSFIERMTNFDKNLPNEKVLPKHSLLYEYFTVYNELTKVKVT--EGMRKPaFLSGEQKKAIVDLLFK--TNR-KVTV   561
WP_039695303 490 SABKFITRMTLNDLYLPEEKVLPKHSHVYETAVVMELTKIKYVN--EQGKES-FFDSNMKQEIFDHVFK--ENR-KVTK   563
WP_045635197 487 SAEDFINKMTNYDLYLPEEKVLPKHSLLYETFAVYNELTKVKFIA--BGLRDYqFLDSGQKKQIVNQLFK--ENR-KVTE  561
5AXW_A        230 --KEWYEMLMGHCTYFFEELRSVKYAYNADLYNALNDLNNLVITR---DENEKLeYYE--KFQIIENVFK--QKK-KPTL 299
WP_009880683 171 SAQSFIERMTNFDKNLPNEKVLPKHSLLYEYFTVYNELTKVKVT--EGMRKPaFLSGEQKKAIVDLLFK--TNR-KVTV   245
WP_010922251 487 SAQSFIERMTNFDKNLPNEKVLPKHSLLYEYFTVYNELTKVKVT--EGMRKPaFLSGEQKKAIVDLLFK--TNR-KVTV   561
WP_011054416 487 SAQSFIERMTNFDKNLPNEKVLPKHSLLYEYFTVYNELTKVKVT--EGMRKPaFLSGEQKKAIVDLLFK--TNR-KVTV   561
WP_011284745 487 SAQSFIERMTNFDKNLPNEKVLPKHSLLYEYFTVYNELTKVKVT--EGMRKPaFLSGEQKKAIVDLLFK--TNR-KVTV   561
WP_011527619 487 SAQSFIERMTNFDKNLPNEKVLPKHSLLYEYFTVYNELTKVKVT--EGMRKPaFLSGEQKKAIVDLLFK--TNR-KVTV   561
WP_012560673 487 SAQSFIERMTNFDKNLPNEKVLPKHSLLYEYFTVYNELTKVKVT--EGMRKPaFLSGEQKKAIVDLLFK--TNR-KVTV   561
WP_014407541 487 SAQSFIERMTNFDKNLPNEKVLPKHSLLYEYFTVYNELTKVKVT--EGMRKPaFLSGEQKKAIVDLLFK--TNR-KVTV   561
```

```
                    -continued

WP_020905136   487  SAQSFIERMTNFDKNLPNEKVLPKHSLLYEYFTVYNELTKVKYVT--EGMRKPaFLSGEQKKAIVDLLFK--TNR-KVTV  561
WP_023080005   487  SAQSFIERMTNFDKNLPNEKVLPKHSLLYEYFTVYNELTKVKYVT--EGMRKPaFLSGEQKKAIVDLLFK--TNR-KVTV  561
WP_023610282   487  SAQSFIERMTNFDKNLPNEKVLPKHSLLYEYFTVYNELTKVKYVT--EGMRKPaFLSGEQKKAIVDLLFK--TNR-KVTV  561
WP_030125963   487  SAQSFIERMTNFDKNLPNEKVLPKHSLLYEYFTVYNELTKVKYVT--EGMRKPaFLSGEQKKAIVDLLFK--TNR-KVTV  561
WP_030126706   487  SAQSFIERMTNFDKNLPNEKVLPKHSLLYEYFTVYNELTKVKYVT--EGMRKPaFLSGEQKKAIVDLLFK--TNR-KVTV  561
WP_031488318   487  SAQSFIERMTNFDKNLPNEKVLPKHSLLYEYFTVYNELTKVKYVT--EGMRKPeFLSGEQKKAIVDLLFK--TNR-KVTV  561
WP_032460140   487  SAQSFIERMTNFDKNLPNEKVLPKHSLLYEYFTVYNELTKVKYVT--EGMRKPaFLSGEQKKAIVDLLFK--TNR-KVTV  561
WP_032461047   487  SAQSFIERMTNFDKNLPNEKVLPKHSLLYEYFTVYNELTKVKYVT--EGMRKPaFLSGEQKKAIVDLLFK--TNR-KVTV  561
WP_032462016   487  SAQSFIERMTNFDKNLPNEKVLPKHSLLYEYFTVYNELTKVKYVT--EGMRKPaFLSGEQKKAIVDLLFK--TNR-KVTV  561
WP_032462936   487  SAQSFIERMTNFDKNLPNEKVLPKHSLLYEYFTVYNELTKVKYVT--EGMRKPaFLSGEQKKAIVDLLFK--TNR-KVTV  561
WP_032464890   487  SAQSFIERMTNFDKNLPNEKVLPKHSLLYEYFTVYNELTKVKYVT--EGMRKPaFLSGEQKKAIVDLLFK--TNR-KVTV  561
WP_033888930   312  SAQSFIERMTNFDKNLPNEKVLPKHSLLYEYFTVYNELTKVKYVT--EGMRKPaFLSGEQKKAIVDLLFK--TNR-KVTV  386
WP_038431314   487  SAQSFIERMTNFDKNLPNEKVLPKHSLLYEYFTVYNELTKVKYVT--EGMRKPaFLSGEQKKAIVDLLFK--TNR-KVTV  561
WP_038432938   487  SAQSFIERMTNFDKNLPNEKVLPKHSLLYEYFTVYNELTKVKYVT--EGMRKPaFLSGEQKKAIVDLLFK--TNR-KVTV  561
WP_038434062   487  SAQSFIERMTNFDKNLPNEKVLPKHSLLYEYFTVYNELTKVKYVT--EGMRKPaFLSGEQKKAIVDLLFK--TNR-KVTV  561
BAQ51233       398  SAQSFIERMTNFDKNLPNEKVLPKHSLLYEYFTVYNELTKVKYVT--EGMRKPaFLSGEQKKAIVDLLFK--TNR-KVTV  472
KGE60162            ----------------------------------------------------------------------------
KGE60856            ----------------------------------------------------------------------------
WP_002989955   487  SAQSFIERMTNFDKNLPNEKVLPKHSLLYEYFTVYNELTKVKYVT--EGMRKPaFLSGEQKKAIVDLLFK--TNR-KVTV  561
WP_003030002   487  SAEKFITRMTLNDLYLPEEKVLPKHSLLYETFTVYNELTKVKYVN--EQGEAK-FFDANMKQEIFDHVFK--ENR-KVTK  560
WP_003065552   490  SAEKFITRMTLNDLYLPEEKVLPKHSHVYETYAVYNELTKIKVVN--EQGKDS-FFDSNMKQEIFDHVFK--ENR-KVTK  563
WP_001040076   488  SAEAFIHRMTNNDLYLPEEKVLPKHSLIYEKFTVYNELTKVRFLA--EGFKDF-qFLNRKQKETIENSLFK--EKR-KVTE  562
WP_001040078   488  SAEAFIHRMTNNDFYLPEEKVLPKHSLIYEKFTVYNELTKVRYKN--EQGETY-FFDSNIKQEIFDGVFK--EHR-KVSK  561
WP_001040080   488  SAEAFIHRMTNNDFYLPEEKVLPKHSLIYEKFTVYNELTKVRYKN--EQGETY-FFDSNIKQEIFDGVFK--EHR-KVSK  561
WP_001040081   488  SAEAFIHRMTNNDFYLPEEKVLPKHSLIYEKFTVYNELTKVRYKN--EQGETY-FFDSNIKQEIFDGVFK--EHR-KVSK  561
WP_001040083   488  SAEAFIHRMTNNDFYLPEEKVLPKHSLIYEKFTVYNELTKVRYKN--EQGETY-FFDSNIKQEIFDGVFK--EHR-KVSK  561
WP_001040085   488  SAEAFIHRMTNNDFYLPEEKVLPKHSLIYEKFTVYNELTKVRYKN--EQGETY-FFDSNIKQEIFDGVFK--EHR-KVSK  561
WP_001040087   488  SAEAFIHRMTNNDFYLPEEKVLPKHSLIYEKFTVYNELTKVRYKN--EQGETY-FFDSNIKQEIFDGVFK--EHR-KVSK  561
WP_001040088   488  SAEAFIHRMTNNDFYLPEEKVLPKHSLIYEKFTVYNELTKVRYKN--EQGETY-FFDSNIKQEIFDGVFK--EHR-KVSK  561
WP_001040089   488  SAEAFIHRMTNNDFYLPEEKVLPKHSLIYEKFTVYNELTKVRYKN--EQGETY-FFDSNIKQEIFDGVFK--EHR-KVSK  561
WP_001040090   488  SAEAFIHRMTNNDFYLPEEKVLPKHSLIYEKFTVYNELTKVRYKN--EQGETY-FFDSNIKQEIFDGVFK--EHR-KVSK  561
WP_001040091   488  SAEAFIHRMTNNDFYLPEEKVLPKHSLIYEKFTVYNELTKVRFLA--EGFKDF-qFLNRKQKETIENSLEK--EKR-KVTE  562
WP_001040092   488  SAEAFIHRMTNNDFYLPEEKVLPKHSLIYEKFTVYNELTKVRFLA--EGFKDF-qFLNRKQKETIENSLEK--EKR-KVTE  562
WP_001040094   488  SAEAFIHRMTNNDFYLPEEKVLPKHSLIYEKFTVYNELTKVRYKN--EQGETY-FFDSNIKQEIFDGVFK--EHR-KVSK  561
WP_001040095   488  SAEAFIHRMTNNDFYLPEEKVLPKHSLIYEKFTVYNELTKVRFLA--EGFKDF-qFLNRKQKETIENSLEK--EKR-KVTE  562
WP_001040096   488  SAEAFIHRMTNNDFYLPEEKVLPKHSLIYEKFTVYNELTKVRFLA--EGFKDF-qFLNRKQKETIENSLEK--EKR-KVTE  562
WP_001040097   488  SAEAFIHRMTNNDFYLPEEKVLPKHSLIYEKFTVYNELTKVRFLA--EGFKDF-qFLNRKQKETIENSLEK--EKR-KVTE  562
WP_001040098   488  SAEAFIHRMTNNDFYLPEEKVLPKHSLIYEKFTVYNELTKVRFLA--EGFKDF-qFLNRKQKETIENSLEK--EKR-KVTE  562
WP_001040099   488  SAEAFIHRMTNNDFYLPEEKVLPKHSLIYEKFTVYNELTKVRYKN--EQGETY-FFDSNIKQEIFDGVFK--EHR-KVSK  561
WP_001040100   488  SAEAFIHRMTNNDFYLPEEKVLPKHSLIYEKFTVYNELTKVRYKN--EQGETY-FFDSNIKQEIFDGVFK--EHR-KVSK  561
WP_001040104   488  SAEAFIHRMTNNDFYLPEEKVLPKHSLIYEKFTVYNELTKVRYKN--EQGETY-FFDSNIKQEIFDGVFK--EHR-KVSK  561
WP_001040105   488  SAEAFIHRMTNNDFYLPEEKVLPKHSLIYEKFTVYNELTKVRYKN--EQGETY-FFDSNIKQEIFDGVFK--EHR-KVSK  561
WP_001040106   488  SAEAFIHRMTNNDFYLPEEKVLPKHSLIYEKFTVYNELTKVRYKN--EQGETY-FFDSNIKQEIFDGVFK--EHR-KVSK  561
WP_001040107   488  SAEAFIHRMTNNDFYLPEEKVLPKHSLIYEKFTVYNELTKVRFLA--EGFKDF-qFLNRKQKETIENSLEK--EKR-KVTE  562
WP_001040108   488  SAEAFIHRMTNNDFYLPEEKVLPKHSLIYEKFTVYNELTKVRYKN--EQGETY-FFDSNIKQEIFDGVFK--EHR-KVSK  561
WP_001040109   488  SAEAFIHRMTNNDFYLPEEKVLPKHSLIYEKFTVYNELTKVRYKN--EQGETY-FFDSNIKQEIFDGVFK--EHR-KVSK  561
WP_001040110   488  SAEAFIHRMTNNDFYLPEEKVLPKHSLIYEKFTVYNELTKVRYKN--EQGETY-FFDSNIKQEIFDGVFK--EHR-KVSK  561
WP_015058523   488  SAEAFIHRMTNNDFYLPEEKVLPKHSLIYEKFTVYNELTKVRYKN--EQGETY-FFDSNVKQEIFDGVFK--EHR-KVSK  561
WP_017643650   488  SAEAFIHRMTNNDFYLPEEKVLPKHSLIYEKFTVYNELTKVRFLA--EGFKDF-qFLNRKQKETIENSLEK--EKR-KVTE  562
WP_017647151   488  SAEAFIHRMTNNDFYLPEEKVLPKHSLIYEKFTVYNELTKVRYKN--EQGETY-FFDSNIKQEIFDGVFK--EHR-KVSK  561
WP_017648376   488  SAEAFIHRMTNNDFYLPEEKVLPKHSLIYEKFTVYNELTKVRYKN--EQGETY-FFDSNIKQEIFDGVFK--EHR-KVSK  561
WP_017649527   488  SAEAFIHRMTNNDFYLPEEKVLPKHSLIYEKFTVYNELTKVRYKN--EQGETY-FFDSNIKQEIFDGVFK--EHR-KVSK  561
WP_017771611   488  SAEAFIHRMTNNDFYLPEEKVLPKHSLIYEKFTVYNELTKVRYKN--EQGETY-FFDSNIKQEIFDGVFK--EHR-KVSK  561
```

```
-continued

WP_017771984   488  SAEAFIHRMTNNDFYLPEEKVLPKHSLIYEKFTVYNELTKVRYKN--EQGETY-FFDSNIKQEIFDGVFK--EHR-KVSK   561
CFQ25032       488  SAEAFIHRMTNNDFYLPEEKVLPKHSLIYEKFTVYNELTKVRYKN--EQGETY-FFDSNIKQEIFDGVFK--EHR-KVSK   561
CFV16040       488  SAEAFIHRMTNNDFYLPEEKVLPKHSLIYEKFTVYNELTKVRYKN--EQGETY-FFDSNIKQEIFDGVFK--EHR-KVSK   561
KLJ37842       488  SAEAFIHRMTNNDFYLPEEKVLPKHSLIYEKFTVYNELTKVRYKN--EQGETY-FFDSNIKQEIEDGVEK--EHR-KVSK   561
KLJ72361       488  SAEAFIHRMTNNDFYLPEEKVLPKHSLIYEKFTVYNELTKVRYKN--EQGETY-FFDSNIKQEIEDGVEK--EHR-KVSK   561
KLL20707       488  SAEAFIHRMTNNDFYLPEEKVLPKHSLIYEKFTVYNELTKVRYKN--EQGETY-FFDSNIKQEIEDGVEK--EHR-KVSK   561
KLL42645       488  SAEAFIHRMTNNDLYLPEEKVLPKHSLIYEKFTVYNELTKVRYKN--EQGETY-FFDSNIKQEIEDGVEK--EHR-KVSK   561
WP_047207273   488  SAEAFIHRMTNNDLYLPEEKVLPKHSLIYEKFTVYNELTKVRYKN--EQGETY-FFDSNIKQEIEDGVEK--EHR-KVSK   561
WP_047209694   488  SAEAFIHRMTNNDLYLPEEKVLPKHSLIYEKFTVYNELTKVRFLA--EGFKDFqFLNRKQKETIFNLFK--EKR-KVTE   562
WP_050198062   488  SAEAFIHRMTNNDLYLPEEKVLPKHSLIYEKFTVYNELTKVRYKN--EQGETY-FFDSNIKQEIEDGVEK--EHR-KVSK   561
WP_050201642   488  SAEAFIHRMTNNDLYLPEEKVLPKHSLIYEKFTVYNELTKVRYKN--EQGETY-FFDSNIKQEIEDGVEK--EHR-KVSK   561
WP_050204027   488  SAEAFIHRMTNNDLYLPEEKVLPKHSLIYEKFTVYNELTKVRYKN--EQGETY-FFDSNIKQEIEDGVEK--EHR-KVSK   561
WP_050881965   488  SAEAFIHRMTNNDLYLPEEKVLPKHSLIYEKFTVYNELTKVRYKN--EQGETY-FFDSNIKQEIEDGVEK--EHR-KVSK   561
WP_050886065   488  SAEAFIHRMTNNDLYLPEEKVLPKHSLIYEKFTVYNELTKVRYKN--EQGETY-FFDSNIKQEIEDGVEK--EHR-KVSK   561
AHN30376       488  SAEAFIHRMTNNDLYLPEEKVLPKHSLIYEKFTVYNELTKVRYKN--EQGETY-FFDENVKQEIEDGVEK--EHR-KVSK   561
EA078426       488  SAEAFIHRMTNNDLYLPEEKVLPKHSLIYEKFTVYNELTKVRYKN--EQGETY-FFDSNIKQEIEDGVEK--EHR-KVSK   561
CCW42055       488  SAEAFIHCMTNNDLYLPEEKVLPKHELLYETFTVYNELTKVKVYN--EQGEAK-FFDANMKQEIFDHVFK--EYR-KVSK   560
WP_003041502   488  SAEKFITRMTLNDLYLPEEKVLPKHELLYETFTVYNELTKVKVYN--EQGEAK-FFDTNMKQEIFDHVFK--ENR-KVTK   561
WP_037593752   488  SAEKFITRMTLNDLYLPEEKVLPKHSPLYETFTVYNELTKVKVYN--EQGEAK-FFDTNMKQEIFDHVFK--ENR-KVTK   561
WP_049516684   488  SAEKFITRMTLNDLYLPEEKVLPKHSPLYETFTVYNELTKVKVYN--EQGEAK-FFDTNMKQEIFDHVEK--ENR-KVTK   561
GAD46167       487  SAEKFITRMTLNDLYLPEEKVLPKHSPLYEIFTVYNELTKVKVYT--EQGEAK-FFDTNMKQEIFDHVFK--ENR-KVTV   560
WP_018363470   488  SAEKFITRMTLNDLYLPEEKVLPKHSHVYETFAVYNELTKVKVYT--EQGKDS-FFDSNMKQEIFDHVFK--ENR-KVTV   561
WP_003043819   497  SAQSFIERMTNEDEQLPNKKVLPKHELLYEYFTVYNELTKVKVYT--ERMRKPeFLSGEQKKAIVDLLFK--TNR-KVTV   571
WP_006269658   487  SAQSFIERMTNEDKNLPNEKVLPKHELLYEYFTVYNELTKVKVYT--EQGMRKPeFLEGKQKEAIVDLLFK--TNR-KVTV   560
WP_048800889   487  SAQSFIERMTNEDKNLPNEKVLPKHELLYEYFTVYNELTKVKVYT--EQGMRKPeFLEGKQKEAIVDLLFK--TNR-KVTV   560
WP_012767106   487  SAQSFIERMTNEDKNLPNEKVLPKHELLYEYFTVYNELTKVKVYT--EQGMRKPeFLEGKQKEAIVDLLFK--TNR-KVTV   560
WP_014612333   488  SAQSFIERMTNEDKNLPNEKVLPKHELLYEYFTVYNELTKVKVYT--EQGMRKPeFLEGKQKEAIVDLLFK--TNR-KVTV   561
WP_015017095   487  SAQSFIERMTNEDKNLPNEKVLPKHSHVYETFAVYNELTKVKVYT--EQGMRKPeFLEGKQKEAIVDLLFK--TNR-KVTV   560
WP_015057649   487  SAQSFIERMTNEDKNLPNEKVLPKHELLYEYFTVYNELTKVKVYT--EQGMRKPeFLEGKQKEAIVDLLFK--TNR-KVTV   560
WP_048327215   487  SAQSFIERMTNEDKNLPNEKVLPKHELLYEYFTVYNELTKVKVYT--EQGMRKPaELSGEQKKAIVDLLFK--TNR-KVTV   560
WP_049519324   487  SAQSFIERMTNEDKNLPNEKVLPKHELLYEYFTVYNELTKVKVYT--EQGMRKPeFLEGKQKEAIVDLLFK--TNR-KVTV   560
WP_012515931   487  SAQSFIERMTKNDLYLPNEKVLPKHELLYEYFTVYNELTKVKVYT--EQGMTRPqFLEADQKQAIVDLLFK--TNR-KVTV   561
WP_021320964   487  SAQSFIEKMTKNDLYLPNEKVLPKHELLYEYFTVYNELTKVKVYAT-EQGMTRPqFLEADQKQAIVDLLFK--TNR-KVTV   561
WP_037581760   487  SAQIFIEKMTKNDLYLPNEKVLPKHELLYEYFTVYNELTKVKVYAT-EQGMTRPqFLEADQKQAIVDLLFK--TNR-KVTV   561
WP_004232481   488  SAEKFITRMTLNDLYLPEEKVLPKHSHVYETFAVYNELTKIKVYN--EQGKSF-FFDSNMKQEIFDHVFK--ENR-KVTK   561
WP_009854540   487  SAEKFITRMTLNDLYLPEEKVLPKHELLYEYFAVYNELTKVKVYN--EQGKES-FFDSNMKQEIFDHVFK--ENR-KVTK   560
WP_012962174   488  SAEKFITRMTLNDLYLPEEKVLPKHELLYEYFAVYNELTKVKVYN--EQGKEN-FFDANMKQEIFEHVFK--ENR-KVTK   561
WP_039695303   490  SAEKFINRMTLNDLYLPEEKVLPKHSHVYETFAVYNELTKVKVYN--EQGKES-FFDSNMKQEIFDHVFK--ENR-KVTK   563
WP_014334983   487  SAEKFITRMTLNDLYLPEEKVLPKHSPLYEMMVYNELTKVKVYN--EQGESP-FFDANMKQEIFDGVFK--ENR-KVTK   560
WP_030099269   487  SAEKFIERMTNFDTYLPEEKVLPKHSPLYEMMVYNELTKVKVYQT--EGMKRPvFLSSEDKEEIVNLLFK--ENR-KVTV   560
AHY15608       487  SAEKFIERMTNFDTYLPEEKVLPKHSPLYEMMVYNELTKVKVYQT--EGMKRPvFLSSEDKEEIVNLLFK--KER-KVTV   561
AHY17476       487  SAEKFIERMTNFDTYLPEEKVLPKHSPLYEMMVYNELTKVKVYQT--EGMKRPvFLSSEDKEEIVNLLFK--KER-KVTV   561
ESR09100            SAEKFIERMTNFDTYLPEEKVLPKHSPLYEMMVYNELTKVKVYQT--EGMKRPvFLSSEDKEEIVNLLFK--KER-KVTV   561
AGM98575       487  SARAFIERMTNFDTYLPEEKVLPKHSPLYEMMVYNELTKVKVYKT--EQGKTA-FFDANMKQEIFDGVFK--VYR-KVTK   560
ALF27331       500  SASRFIERMTLHDLYLPNQKVLPRHSLIYEKFTVFNELTKVKYKT--EGGKEV-YFSKTDKENIFDSLFK--RYR-KVTK   573
WP_018372492   488  SAEDFINKMTNYDLYLPEEKVLPKHSLIYEKFTVYNELTKVKFIA--EGLRDYqFLDSGQKQIVTQLFK--EKR-KVTE   562
WP_045618028   488  SAEDFINKMTNYDLYLPNQKVLPKHSLIYEKFTVYNELTKVKFIA--EGLRDYqFLDSGQKQIVNQLFK--VYR-KVTE   561
WP_045635197   487  SAEAFINRMTNYDLYLPNQKVLPKHSLIYEKFTVYNELTKVKYKT--EQGKTA-FFDANMKQEIFDGVFK--VYR-KVTK   560
WP_002263549   487  SAEAFINRMTNYDLYLPNQKVLPKHSLIYEKFTVYNELTKIKVKT--EQGKTA-FFDANMKQEIFDGVFK--VYR-KVTK   560
WP_002263887   487  SVEAFINRMTNYDLYLPNQKVLPKHSLIYEKFTVYNELTKVKYKT--EQGKTA-FFDANMKQEIFDGVFK--VYR-KVTK   560
WP_002264920   487  SAEAFINRMTNYDLYLPNQKVLPKHSLIYEKFTVYNELTKVKYKT--EQGKTA-FFDANMKQEIFDGVFK--VYR-KVTK   560
WP_002269043   487  SAEAFINRMTNYDLYLPNQKVLPKHSLIYEKFTVYNELTKVKYKT--EQGKTA-FFDANMKQEIFDGVFK--VYR-KVTK   560
WP_002269448   487  SAEAFINRMTNYDLYLPNQKVLPKHSLIYEKFTVFNELTKVKYKT--EQGKTA-FFDANMKQEIFDGVFK--VYR-KVTK   560
```

-continued

| | | | |
|---|---|---|---|
| WP_002271977 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002272766 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002273241 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002275430 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002276448 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002277050 | 487 | SAQAFIEHMTNDLYLPNQKVLPKHSLLYEKFTVYNELTKIKYVT--EIGEAK-FFDANLKQEIFDGLFK--HER-KVTK | 560 |
| WP_002277364 | 487 | SAEAFIINRMTNDLYLPNQKVLPKHSLLYEKFTVYNELTKVYKT--EQGKTA-FFDANLKQEIFDGVFK--HER-KVTK | 560 |
| WP_002279025 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002279859 | 487 | SVEAFIINRMTNDLYLPNQKVLPKHSLLYEKFTVYNELTKVYKT--EQGETA-FFDANMKQEIFDGVFK--VYR-KVTK | 560 |
| WP_002280230 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002281696 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002282247 | 487 | SAQAFIEHMTNNDLYLPNEKVLPKHSPLYEKVTVYNELTKVYKT--EQGKTA-FFDANLKQEIFDGLFK--HER-KVTK | 560 |
| WP_002282906 | 487 | SAEAFIINRMTNDLYLPNQKVLPKHSLLYEKFTVYNELTKVYKT--EIGEAK-FFDANMKQEIFDGVFK--VYR-KVTK | 560 |
| WP_002283846 | 487 | SVEAFIINRMTNDLYLPNQKVLPKHSLLYEKFTVYNELTKVYKT--EQGKTA-FFDANMKQEIFDGVFK--VYR-KVTK | 560 |
| WP_002287255 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002288990 | 487 | SVEAFIINRMTNDLYLPNQKVLPKHSLLYEKFTVYNELTKVYKT--EQGKTA-FFDANMKQEIFDGVFK--VYR-KVTK | 560 |
| WP_002289641 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002290427 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_002295753 | 487 | SVEAFIINRMTNDLYLPNQKVLPKHSLLYEKFTVYNELTKVYKT--EQGKTA-FFDANMKQEIFDGVFK--VYR-KVTK | 560 |
| WP_002296423 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_003044887 | 497 | SAEKFITRMTLNDLYLPKHSLLYETFTVYNELTKVKVN--EQGEAK-FFDANMKQEIFDHVFK--ENR-KVTK | 570 |
| WP_003055844 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_003067203 | 487 | SVEAFIINRMTNDLYLPNQKVLPKHSLLYEKFTVYNELTKVYKT--EQGKTA-FFDANMKQEIFDGVFK--VYR-KVTK | 560 |
| WP_003103090 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_003352408 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_012997688 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_014677909 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_019312892 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_019313659 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_019314093 | 487 | SVEAFIINRMTNDLYLPNQKVLPKHSLLYEKFTVYNELTKVYKT--EQGKTA-FFDANMKQEIFDGVFK--VYR-KVTK | 560 |
| WP_019315370 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_019803776 | 487 | SAEAFIINRMTNDLYLPNQKVLPKHSLLYEKFTVYNELTKVYKT--EIGEAK-FFDANLKQEIFDGLFK--HER-KVTK | 560 |
| WP_019805234 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_024783594 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_024784288 | 487 | SAQAFIEHMTNDLYLPNQKVLPKHSPLYEKYTVYNELTKIKYVT--EIGEAK-FFDANLKQEIFDGLFK--HER-KVTK | 560 |
| WP_024784666 | 487 | SAEAFIINRMTNDLYLPNQKVLPKHSLLYEKFTVYNELTKVYKT--EQGKTA-FFDANMKQEIFDGVFK--VYR-KVTK | 560 |
| WP_024784894 | 456 | SAEAFIERMTNFDTYLPNQKVLPKHSLLYEMFTVYNELTKVKYQA--EGMRKPeFLSSEEKIRIVSNLFK--TER-KVTV | 530 |
| WP_024786433 | 489 | SAQAFIINRMTNDLYLPNEKVLPKHSLLYEKFTVYNELTKVYKT--EIGEAK-FFDANLKQEIFDGLFK--HER-KVTK | 563 |
| WP_049473442 | 488 | SAEAFIINRMTNDLYLPNQKVLPKHSLLYEKFTVYNELTKVKFIA--EGLRDYqFLDSGQKKIINQLFK--EKR-KVTE | 562 |
| WP_049745547 | 480 | SAEAFIINRMTNDLYLPNQKVLPKHSLLYEKFTVYNELTKVKFIA--EGLRDYqFLDSGQKQIVNQLFK--VYR-KVTK | 560 |
| EMC03581 | 480 | SAESFIINKMTNDLYLPEEKVLPKHSLLYETFAVYNELTKVKFIA--EGLRDYqFLDSRQKDIFYTLFKaeDKR-KVTE | 553 |
| WP_000428612 | 488 | SAEDFIINKMTNDLYLPEEKVLPKHSLLYETFAVYNELTKVKFIA--EGLRDYqFLDSGQKKQIVTQLFK--EKR-KVTE | 564 |
| WP_000428613 | 488 | SAEDFIINKMTNDLYLPEEKVLPKHSLLYETFAVYNELTKVKFIA--EGLRDYqFLDSGQKKQIVNQLFK--EKR-KVTE | 562 |
| WP_049525028 | 487 | SAEDFIHRMTNDLYLPEEKVLPKHSLLYETFAVYNELTKVKFIA--EGMKDYqFLDSGQKKQIVNQLFK--EKR-KVTE | 561 |
| WP_003107102 | 456 | SAKVFIERMTNFDTYLPEEKVLPKHSLLYEMFTVYNELTKVKYQA--EGMRKPeFLSSEEKIRIVSNLFK--TER-KVTV | 530 |
| WP_054279288 | 489 | SAQAFIERMTNDLYLPQEKVLPKHSLLTYEYFTVYNELTKVYKT--EGMTKPeFLSAGQKEQIVELLFK--KYR-KVTV | 563 |
| WP_049531101 | 488 | SAEAFIINKMTNDLYLPEEKVLPKHSLLYETFAVYNELTKVKFIA--EGLRDYqFLDSGQKKIINQLFK--EKR-KVTE | 562 |
| WP_049538452 | 488 | SAEDFIINKMTNDLYLPEEKVLPKHSLLYETFAVYNELTKVKFIA--EGLRDYqFLDSGQKQIVNQLFK--EKR-KVTE | 562 |
| WP_049549711 | 488 | SAEDFIINKMTNDLYLPEEKVLPKHSLLYETFAVYNELTKVKFIA--EGLRDYqFLDSGQKQIVNQLFK--EKR-KVTE | 562 |
| WP_007896501 | 490 | SAQAFIEGMTNDTYLPEEKVLPKHSLLYEMFTVYNELTKVKVIA--ENMTKPlYLSAEQKEATIDHLFK--QTR-KVTV | 564 |
| EFR44625 | 442 | SAQAFIEGMTNDTYLPEEKVLPKHSLLYEMFTVYNELTKVKVIA--ENMTKPlYLSAEQKEATIDHLFK--QTR-KVTV | 516 |
| WP_002897477 | 487 | SAEDFIHRMTNDLYLPEEKVLPKHSLLYETFAVYNELTKVKFIA--EGLRDYqFLDSGQKKQIVNQLFK--EKR-KVTE | 561 |
| WP_002906454 | 487 | SAEDFIINKMTNDLYLPEEKVLPKHSLLYETFAVYNELTKVKFIA--EGLRDYqFLDSGQKKQIVNQLFK--DKR-KVTE | 561 |

```
WP_009729476  488  SAEDFINKMTNDLYLPEEKVLPKHSLLYETFAVYNELTKVKFIA-EGLRDYqFLDSGQKKQIVTQLFK--EKR-KVTE  562
CQR24647      488  SAQAFIERMTNNDLYLPDQKVLPKHSLLYQKFAVYNELTKIKYVT-ETGEAR-LEDVFLKKEIFDGLEK--KER-KVTK  561
WP_000066813  488  SAEDFINKMTNDLYLPEEKVLPKHSLLYETFAVYNELTKVKFIA-EGLTRYqFLDKKQKKDIFDTFFKaeNKR-KVTE  564
WP_009754323  488  SAESFINKMTNDLYLPEEKVLPKHSLLYETFAVYNELTKVKFIA-EGLRDYqFFDSGQKKQIVNQLFK--EKR-KVTE  562
WP_044674937  487  SAENFITRMTNDYQYLPDQKVLPKHSLLYEKFAVYNELTKVRYVT-EGMRDYqFLDSGQKKDIVKTLFK--TKR-KVTA  561
WP_044676715  487  SAENFITRMTNDYQYLPDQKVLPKHSLLYEKFAVYNELTKVRYVT-EQGKSF-FFDANMKQEIFDGVEK--VYR-KVTK  560
WP_044680361  487  SAENFITRMTNDYQYLPDQKVLPKHSLLYEKFAVYNELTKVRYVT-EQGKSF-FFDANMKQEIFDGVEK--VYR-KVTK  560
WP_044681799  487  SAENFITRMTNDYQYLPDQKVLPKHSLLYEKFAVYNELTKVKFIA-EGMRDYqFLDSGQKKDIVKTLFK--TKR-KVTA  561
WP_049533112  487  SAEKFITRMTLNDLYLPEEKVLPKHSLLYETFTVYNELTKVKYVN-EQGEAK-FFDANMKQEIFDHVEK--ENR-KVTK  560
WP_029090905  472  SAEKFITRMTNKCTYLIHEDVIPKHSFSYAKFEVLNELANKIRLDG------KP--IDPLKKRIFEGLFL--EKtKVTQ  540
WP_006506696  499  TAEGFIKRMRSYCTYFPDEEVLPKNSLLVSKYEVLNELNKIRVDD--------kLLEVDVKNDIYNELFM--KNK-TVTE  567
AIT42264      487  SAQSFIERMTNEDKNLPNEKVLPKHSLLYEYFTVYNELTKVKVT-EGMRKPaELSGEQKKAIVDLLFK--TNR-KVTK  561
WP_034440723  494  SAELFIENLTSRDTYLPDEPVLPKRSLLIYQKFTIFNELTKISYID-NFSSREKIAIENDLFK---NKsKVTK  567
AKQ21048      487  SAQSFIERMTNEDKNLPNEKVLPKHSLLYQTFEVYNELTKVRYTN-EQGKTE-KLNRQQKAEIIETLFK-qKNR--VRE  561
WP_004636532  489  SAEKFIERMTNMDTYLLEEKVLPKHSLLYEYFTVYNELTKVRYTN-EQGKTB-KLNRQQKAEIIETLFK-qKNR--VRE  562
WP_002364836  496  SATAFIERMTNEDTYLPSEKVLPKHSLLYEKFMVFNELTKISYTD-DRGIKA-NFSGKEKEKIFDYLFK--TRR-KVKK  569
WP_016631044  447  SATAFIERMTNEDTYLPSEKVLPKHSLLYEKFMVFNELTKISYTD-DRGIKA-NFSGKEKEKIFDYLFK--TRR-KVKK  520
EMS75795      232  SAMKFIQRMINYDTYLPTEKVLPKHSLLYQKYTIFNELTKVAYKD-ERGIKH-QESSKEKEREIFKELFQ--KQR-KVTV  305
WP_002373311  496  SATAFIERMTNEDTYLPSEKVLPKHSLLYEKFMVFNELTKISYTD-DRGIKA-NFSGKEKEKIFDYLFK--TRR-KVKK  569
WP_002378009  496  SATAFIERMTNEDTYLPSEKVLPKHSLLYEKFMVFNELTKISYTD-DRGIKA-NFSGKEKEKIFDYLFK--TRR-KVKK  569
WP_002407324  496  SATAFIERMTNEDTYLPSEKVLPKHSLLYEKFMVFNELTKISYTD-DRGIKA-NFSGKEKEKIFDYLFK--TRR-KVKK  569
WP_002413717  498  SATAFIERMTNEDTYLPSEKVLPKHSLLYEKFMVFNELTKISYTD-DRGIKA-NFSGKEKEKIFDYLFK--TRR-KVKK  571
WP_010777580  496  SATAFIERMTNEDTYLPSEKVLPKHSLLYEKFMVFNELTKISYTD-DRGIKA-NFSGKEKEKIFDYLFK--TRR-KVKK  569
WP_010818269  496  SATAFIERMTNEDTYLPSEKVLPKHSLLYEKFMVFNELTKISYTD-DRGIKA-NFSGKEKEKIFDYLFK--TRR-KVKK  569
WP_010824395  496  SATAFIERMTNEDTYLPSEKVLPKHSLLYEKFMVFNELTKISYTD-DRGIKA-NFSGKEKEKIFDYLFK--TRR-KVKK  569
WP_016622645  496  SATAFIERMTNEDTYLPSEKVLPKHSLLYEKFMVFNELTKISYTD-DRGIKA-NFSGKEKEKIFDYLFK--TRR-KVKK  569
WP_033624816  496  SATAFIERMTNEDTYLPSEKVLPKHSLLYEKFMVFNELTKISYTD-DRGIKA-NFSGKEKEKIFDYLFK--TRR-KVKK  569
WP_033625576  496  SATAFIERMTNEDTYLPSEKVLPKHSLLYEKFMVFNELTKISYTD-DRGIKA-NFSGKEKEKIFDYLFK--TRR-KVKK  569
WP_033789179  496  SATAFIERMTNEDTYLPSEKVLPKHSLLYEKFMVFNELTKISYTD-DRGIKA-NFSGKEKEKIFDYLFK--TRR-KVKK  569
WP_002310644  493  SAVRFIERMINTDMYMPHNKVLPKNSLLYQKFSIYNELTKVRYQD-ERGQMN-YFSSIEKKEIFHELFE--KNR-KVTK  566
WP_002312694  494  SAVRFIERMINTDMYIPHNKVLPKNSLLYQKFSIYNELTKVRYQD-ERGQMN-YFSSIEKKEIFHELFE--KNR-KVTK  567
WP_002314015  494  SAVRFIERMNNTDMYIPHNKVLPKNSLLYQKFSIYNELTKVRYQD-ERGQMN-YFSSIEKKEIFHELFE--KNR-KVTK  567
WP_002320716  494  SAVRFIERMINTDMYIPHNKVLPKNSLLYQKFSIYNELTKVRYQD-ERGQMN-YFSSIEKKEIFHELFE--KNR-KVTK  567
WP_002330729  493  SAVRFIERMINTDMYIPHNKVLPKNSLLYQKFSIYNELTKVRYQD-ERGQMN-YESSIEKKEIFHELFE--KNR-KVTK  566
WP_002335161  494  SAVRFIERMINTDMYMPHNKVLPKNSLLYQKFSIYNELTKVRYQD-ERGQMN-YESSIEKKEIFHELFE--KNR-KVTK  567
WP_002345439  494  SAVRFIERMINTDMYMPHNKVLPKNSLLYQKFSIYNELTKVRYQD-ERGQMN-YESSIEKKEIFHELFE--KNR-KVTK  567
WP_034867970  487  SAMRFIQRMTKQDTYLPTEKVLPKNSLLYQKYMIFNELTKVSYKD-ERGVKQ-YFSGDEKQQIFKQLFQ--KERgKITV  561
WP_047937432  494  SAVRFIERMINTDMYMPHNKVLPKNSLLYQKFSIYNELTKVRYQD-ERGQMN-YESSIEKKEIFHELFE--KNR-KVTK  567
WP_010720994  487  SAMRFIQRMTKQDTYLPTEKVLPKNSLLYQKYMIFNELTKVSYKD-ERGVKQ-YFSGDEKQQIFKQLFQ--KERgKITV  561
WP_010737004  487  SAMRFIQRMTKQDTYLPTEKVLPKNSLLYQKYMIFNELTKVSYKD-ERGVKQ-YFSGDEKQQIFKQLFQ--KERgKITV  561
WP_034700478  487  SAMRFIQRMTKQDTYLPTEKVLPKNSLLYQKYMIFNELTKVSYKD-ERGVKQ-YFSGDEKQQIFKQLFQ--KERgKITV  561
WP_007209003  491  SAVAFIERMTIKDIYL-NENVLPRHSLLYEKFTVFNELTKVLAD--DRGVFQ-RFSAEEKEDIFEKLFK--SER-KVTK  563
WP_023511917  486  SAIEFIERMTNQDTYLPKEKVLPKHSLLYQRFMIFNELTKVSYTD-ERGKSH-YFSSEQKRKIFNELFK--QHP-RVTE  559
WP_010770040  490  SATKFIERMTNQDTYLPKEKVLPKHSMIYEKYMVYNELTKVSVD--ERGMNQ-RFSGEEKKQIVEELFK--QSR-KVTK  563
WP_048604708  486  SAELFIERMTNFDLYLPKNSLLYQKYTVYNELTKVKFIK-EQGKVQ-NFSSEEKERIFIDLFK--QHR-KVTK  559
WP_010750235  487  SATKFIQRMINYDTYLPTEKVLPKHSLLYQKYTIFNELTKVAYKD-DRGIKH-QFSSEEKLRIFQELFK--KQR-RVTK  560
AII16583      526  SAQSFIERMTNFDKNLPNEKVLPKHSLLYEYFTVYNELTKVKVT-EGMRKPaFLSGEQKKAIVDLLFK--TNR-KVTV  600
WP_029073316  507  TADEFIKRMRNFCTYFDEPVLAKNSLLVSKYEVLNEINKLRIND-------hLIKRDIKDKMLHTLFM--DHK-SISA  575
WP_031589969  507  TADEFIKRMRNFCTYFPDEPVMAKNSLLVSKYEVLNEINKLRIND-------hLIKRDMKDKMLHTLFM--DHK-SISA  575
KDA45870      485  SAEDFIKRMTINDLYLPTEPVLPKHSLLYERYTIFNELAGVRVT--ENGEAK-YEDAQTKRSIFE-LFK1--DR-KVSE  557
WP_039099354  510  SANEFIKRMTTDTYLLAEDVLPKQSLLYQRFEVLNELNGLKIDD---------LKQAIFTDLFM--QKtSVTV  578
AKP02966      484  SSNKFIRRMTVDSYLVGEPVLPKNSLLIYQRYEVLNELANNIRITEnIKTNPTGsRLTVETKQHIYNELFK--NYK-KITV  560
WP_010991369  493  SAVDFIEKMTNKDTYLPKENVLPKHSLCYQKYLVYNELTKVRYIN-DQGKTS-YFSSQEKEQIENDLFK--QKR-KVKK  566
```

```
                          -continued
WP_033838504  493  SAVDFIEKMTNKDTYLPKENVLPKHSLCYQKLVYNELTKVRYIN--DQGKTS-YFSGQEKEQIENDLFK--QKR-KVKK  566
EHN60060      496  SAVDFIEKMTNKDTYLPKENVLPKHSLCYQKLVYNELTKVRYIN--DQGKTS-YFSGQEKEQIENDLFK--QKR-KVKK  569
EFR89594      262  SAVDFIEKMTNKDTYLPKENVLPKHSLCYQKLVYNELTKVRYIN--DQGKTS-YFSGQEKEQIENDLFK--QKR-KVKK  335
WP_038409211  493  SAIDFIEKMTNKDTYLPKENVLPKHSLCYQKLVYNELTKVRYID--DQGKTH-HFSGQEKEQIENDLFK--QQR-KVKK  566
EFR95520      112  SAIDFIEKMTNKDTYLPKENVLPKHSLCYQKLVYNELTKIRYID--DQGKTH-HFSGQEKQQIFNGLFK--QQR-KVKK  185
WP_003723650  493  SAVDFIEKMTNKDTYLPKENVLPKHSLCYQKMVYNELTKIRYID--DQGKTN-YFSGREKQQVFNDLFK--QKR-KVKK  566
WP_003727705  493  SAVDFIEKMTNKDTYLPKENVLPKHSLCYQKMVYNELTKIRYID--DQGKTN-YFSREKQQIENDLFK--QKR-KVKK  566
WP_003730785  493  SAVDFIEKMTNKDTYLPKENVLPKHSLCYQKMVYNELTKIRYID--DQGKTN-YFSGREKQQIENDLFK--QKR-KVKK  566
WP_003733029  493  SAVDFIEKMTNKDTYLPKENVLPKHSLCYQKMVYNELTKVRYID--DQGKTN-YFSGQEKQQIENDLFK--QKR-KVKK  566
WP_003739838  493  SAVDFIEKMTNKDTYLPKENVLPKHSLCYQKMVYNELTKVRYID--DQGKTN-YFSGQEKEQIENDYFK--QKR-KVKK  566
WP_014601172  493  SAVDFIEKMTNKDTYLPKENVLPKHSLCYQKMVYNELTKVRYID--DQGKTN-YFSGQEKQQIENDLFK--QKR-KVSK  566
WP_023548323  493  SAVDFIEKMTNKDTYLPKENVLPKHSLCYQKMVYNELTKIRYID--DQGKTN-YFSGQEKQQIENDLFK--QKR-KVKK  566
WP_031665337  493  SAVDFIEKMTNKDTYLPKENVLPKHSLCYQKMVYNELTKIRYID--DQGKTN-YFSGQEKQQIENDLFK--QKR-KVKK  566
WP_031669209  493  SAVDFIEKMTNKDTYLPKENVLPKHSLCYQKMVYNELTKIRYID--DQGKTN-YFSGQEKQQIENDLFK--QKR-KVKK  566
WP_033920898  493  SAVDFIEKMTNKDTYLPKENVLPKHSLCYQKMVYNELTKIRYID--DQGKTN-YESGQEKQQIENDLEK--QKR-KVKK  566
AKI42028      496  SAVDFIEKMTNKDTYLPKENVLPKHSLCYQKMVYNELTKVRYID--DQGKTN-YESGQEKQQIENDLFK--QKR-KVKK  569
AKI50529      496  SAVDFIEKMTNKDTYLPKENVLPKHSLCYQKMVYNELTKIRYID--DQGKTN-YESGQEKQQIENDLEK--QKR-KVKK  569
EFR83390        1  --------------------------------------------------------IFNDLEK--QKR-KVKK   14
WP_046323366  493  SAIDFIEKMTNKDTYLPKENVLPKHSMCYQKTMVYNELTKIRYTD--DQGKTH-YESGQEKQQIENDLEK--QKR-KVKK  566
AKE81011      503  SAQSFIERMTNEDKNLPNEKVLPKHSLLYEHTVYNELTKVKYIL-DK AFLDDKVNEEVIEDIIKTLTFEDKDMH     577
CUO82355      503  TAEGFIKRMRSYCTYFPDEEVLPKNSLIVSKYEVYNELNKIRVDD-----kLLEVDKNDIYNELFM--KNK-TVTE    571
WP_033162887  504  TAEGFIERMKNTGTYFPDEPVMAKNSLTVSKFEVLNELNKIRING------kLIAVETKKELLSDLFM--KNK-TITD   572
AGZ01981      520  SAQSFIERMTNEDKNLPNEKVLPKHSLLYEYFTVYNELTKVKYVT--EGMRKPaELSGEQKKAIVDLLFK--TNR-KVTV 594
AKA60242      487  SAQSFIERMTNEDKNLPNEKVLPKHSLLYEYFTVYNELTKVKYVT--EGMRKPaELSGEQKKAIVDLLFK--TNR-KVTV 561
AKS40380      487  SAQSFIERMTNEDKNLPNEKVLPKHSLLYEYFTVYNELTKVKYVT--EGMRKPaELSGEQKKAIVDLLFK--TNR-KVTV 561
4UN5_B        491  SAQSFIERMTNEDKNLPNEKVLPKHSLLYEYFTVYNELTKVKYVT--EGMRKPaELSGEQKKAIVDLLFK--TNR-KVTV 565
WP_010922251  562  KQLKEDYFKK--IECFDSVEISGVEDR---FNASLGTYHDLLKIIKDK DFLDNEENEDILEDIVLTLTLFEDREMIE   633
WP_010922251  564  EKLLNYLNKE--FPEYRIKDLIGLDKEnkSFNASLGTYHDLKKIL-DK AFLDDKVNEEVIEDIIKTLTLFEDKDMIH   637
WP_039695303  562  KDIIHYLHN---VDGYDGIELKGIEKQ--FNASLSTYHDLLKIIKDK EFMDDAKNEAILENIVHTLTIFEDREMIK   632
WP_045635197  300  KQIAKEILVNe-EDIKGYRVTSTGKPe--FTNLKVVHDIKDITARK------ENAELLDQIAKILTIYQSSEDIQ    368
5AXW_A        246  KQLKEDYFKK--IECFDSVEISGVEDR--FNASLGTYHDLLKIIKDK DFLDNEENEDILEDIVLTLTLFEDREMIE   317
WP_099880683  562  KQLKEDYFKK--IECFDSVEISGVEDR--FNASLGTYHDLLKIIKDK DFLDNEENEDILEDIVLTLTLFEDREMIE   633
WP_010922251  562  KQLKEDYFKK--IECFDSVEISGVEDR--FNASLGTYHDLLKIIKDK DFLDNEENEDILEDIVLTLTLFEDREMIE   633
WP_011054416  562  KQLKEDYFKK--IECFDSVEISGVEDR--FNASLGTYHDLLKIIKDK DFLDNEENEDILEDIVLTLTLFEDREMIE   633
WP_011284745  562  KQLKEDYFKK--IECFDSVEISGVEDR--FNASLGTYHDLLKIIKDK DFLDNEENEDILEDIVLTLTLFEDREMIE   633
WP_011285506  562  KQLKEDYFKK--IECFDSVEISGVEDR--FNASLGTYHDLLKIIKDK DFLDNEENEDILEDIVLTLTLFEDREMIE   633
WP_011527619  562  KQLKEDYFKK--IECFDSVEISGVEDR--FNASLGTYHDLLKIIKDK DFLDNEENEDILEDIVLTLTLFEDREMIE   633
WP_012560673  562  KQLKEDYFKK--IECFDSVEISGVEDR--FNASLGTYHDLLKIIKDK DFLDNEENEDILEDIVLTLTLFEDREMIE   633
WP_014407541  562  KQLKEDYFKK--IECFDSVEISGVEDR--FNASLGAYHDLLKIIKDK DFLDNEENEDILEDIVLTLTLFEDRGMIE   633
WP_020905136  562  KQLKEDYFKK--IECFDSVEISGVEDR--FNASLGTYHDLLKIIKDK DFLDNEENEDILEDIVLTLTLFEDKEMIE   633
WP_023080005  562  KQLKEDYFKK--IECFDSVEISGVEDR--FNASLGTYHDLLKIIKDK DFLDNEENEDILEDIVLTLTLFEDKEMIE   633
WP_023610282  562  KQLKEDYFKK--IECFDSVEISGVEDR--FNTSLGTYHDLLKIIKDK DFLDNEENEDILEDIVLTLTLFEDKEMIE   633
WP_030125963  562  KQLKEDYFKK--IECFDSVEISGVEDR--FNASLGTYHDLLKIIKDK DFLDNEENEDILEDIVLTLTLFEDREMIE   633
WP_030126706  562  KQLKEDYFKK--IECFDSVEISGVEDR--FNASLGTYHDLLKIIKDK DFLDNEENEDILEDIVLTLTLFEDREMIE   633
WP_031488318  562  KQLKEDYFKK--IECFDSVEISGVEDR--FNASLGTYHDLLKIIKDK DFLDNEENEDILEDIVLTLTLFEDREMIE   633
WP_032460140  562  KQLKEDYFKK--IECFDSVEISGVEDR--FNASLGTYHDLLKIIKDK DFLDNEENEDILEDIVLTLTLFEDREMIE   633
WP_032461047  562  KQLKEDYFKK--IECFDSVEISGVEDR--FNASLGTYHDLLKIIKDK DFLDNEENEDILEDIVLTLTLFEDREMIE   633
WP_032462016  562  KQLKEDYFKK--IECFDSVEISGVEDR--FNASLGTYHDLLKIIKDK DFLDNEENEDILEDIVLTLTLFEDREMIE   633
WP_032462936  562  KQLKEDYFKK--IECFDSVEISGVEDR--FNASLGTYHDLLKIIKDK DFLDNEENEDILEDIVLTLTLFEDREMIE   633
WP_032464890  562  KQLKEDYFKK--IECFDSVEISGVEDR--FNASLGTYHDLLKIIKDK DFLDNEENEDILEDIVLTLTLFEDREMIE   633
WP_033888930  387  KQLKEDYFKK--IECFDSVEISGVEDR--FNTSLGTYHDLLKIIKDK DFLDNEENEDILEDIVLTLTLFEDREMIE   458
WP_038431314  562  KQLKEDYFKK--IECFDSVEISGVEDR--FNASLGTYHDLLKIIKDK DFLDNEENEDILEDIVLTLTLFEDREMIE   633
WP_038432938  562  KQLKEDYFKK--IECFDSVEISGVEDR--FNASLGTYHDLLKIIKDK DFLDNEENEDILEDIVLTLTLFEDREMIE   633
WP_038434062  562  KQLKEDYFKK--IECFDSVEISGVEDR--FNASLGTYHDLLKIIKDK DFLDNEENEDILEDIVLTLTLFEDREMIE   633
```

```
BAQ51233         473 KQLKEDYFKK--IECFDSVEISGVEDR---FNASLGTYHDLLKIIKDK DFLDNEENEDILEDIVLTLFLFEDREMIE      544
KGE60162             ------------------------------------------------ --------------------------
KGE60856             ------------------------------------------------ --------------------------
WP_002989955     562 KQLKEDYFKK--IECFDSVEISGVEDR---FNASLGTYHDLLKIIKDK DFLDNEENEDILEDIVLTLFLFEDREMIE      633
WP_003030002     561 DKLLNYLNKE-FEEFRIVNLTGLDKEhkAFNSSLGTYHDLRKIL-DK  SFLDDKANEKTIEDIIQTLFLFEDREMIR      634
WP_003065552     564 EKLNYLNKE--FPEYRIKDLIGLDKEhkAFNASLGTYHDLKKIL-DK  AFLDDKVNEEVIEDIIKTLFLFEDKDMIH      637
WP_001040076     563 KDIISFLNK---VDGYEGIAIKGIEKQ---FNASLSTYHDLKKIL-GK --------------------------DFLDNTDNELILEDIVQTLFLFEDREMIK      635
WP_001040078     562 KKLLDFLAKE--YEEFRIVDVIGLDKEhkAFNASLGTYHDLEKIL-DK DFLDNPDNESILEDIVQTLFLFEDREMIK      635
WP_001040080     562 KKLLDFLAKE--YEEFRIVDVIGLDKEhkAFNASLGTYHDLEKIL-DK DFLDNPDNESILEDIIQTLFLFEDREMIK      635
WP_001040081     562 KKLLDFLAKE--YEEFRIVDVIGLDKEhkAFNASLGTYHDLEKIL-DK DFLDNPDNESILEDIIQTLFLFEDREMIK      635
WP_001040083     562 KKLLDFLAKE--YEEFRIVDVIGLDKEhkAFNASLGTYHDLEKIL-DK DFLDNPDNESILEDIVQTLFLFEDREMIK      635
WP_001040085     562 KKLLDFLAKE--YEEFRIVDVIGLDKEhkAFNASLGTYHDLEKIL-DK DFLDNPDNESILEDIVQTLFLFEDREMIK      635
WP_001040087     562 KKLLDFLAKE--YEEFRIVDVIGLDKEhkAFNASLGTYHDLEKIL-DK DFLDNPDNESILEDIVQTLFLFEDREMIR      635
WP_001040088     562 KKLLDFLAKE--YEEFRIVDVIGLDKEhkAFNASLGTYHDLEKIL-DK DFLDNPDNESILEDIVQTLFLFEDREMIR      635
WP_001040089     562 KKLLDFLAKE--YEEFRIVDVIGLDKEhkAFNASLGTYHDLEKIL-DK DFLDNPDNESILEDIVQTLFLFEDREMIR      635
WP_001040090     562 KKLLDFLAKE--YEEFRIVDVIGLDKEhkAFNASLGTYHDLEKIL-DK DFLDNPDNESILEDIVQTLFLFEDREMIR      635
WP_001040091     562 KQLLDFLAKE--FEEFRIVDVTGLDKEhkAFNASLGTYHDLKKIL-GK DFLDNTDNELILEDIVQTLFLFEDREMIR      632
WP_001040092     562 KDIISFLNK---VDGYEGIAIKGIEKQ---FNASLSTYHDLKKIL-GK DFLDNTDNELILEDIVQTLFLFEDREMIR      632
WP_001040094     563 KDIISFLNK---VDGYEGIAIKGIEKQ---FNASLSTYHDLKKIL-GK DFLDNTDNELILEDIVQTLFLFEDREMIR      632
WP_001040095     562 KDIISFLNK---VDGYEGIAIKGIEKQ---FNASLSTYHDLKKIL-GK DFLDNTDNELILEDIVQTLFLFEDREMIR      632
WP_001040096     563 KDIISFLNK---VDGYEGIAIKGIEKQ---FNASLSTYHDLKKIL-GK DFLDNTDNELILEDIVQTLFLFEDREMIR      632
WP_001040097     563 KDIISFLNK---VDGYEGIAIKGIEKQ---FNASLSTYHDLKKIL-GK DFLDNTDNELILEDIVQTLFLFEDREMIR      632
WP_001040098     563 KDIISFLNK---VDGYEGIAIKGIEKQ---FNASLSTYHDLKKIL-GK DFLDNTDNELILEDIVQTLFLFEDREMIR      632
WP_001040099     563 KDIISFLNK---VDGYEGIAIKGIEKQ---FNASLSTYHDLKKIL-GK DFLDNTDNELILEDIVQTLFLFEDREMIR      632
WP_001040100     562 KKLLDFLAKE--YEEFRIVDVIGLDKEhkAFNASLGTYHDLKKIL-GK DFLDNPDNESILEDIVQTLFLFEDREMIK      635
WP_001040104     562 KKLLDFLAKE--YEEFRIVDVIGLDKEhkAFNASLGTYHDLEKIL-DK DFLDNPDNESILEDIVQTLFLFEDREMIK      635
WP_001040105     562 KKLLDFLAKE--YEEFRIVDVIGLDKEhkAFNASLGTYHDLEKIL-DK DFLDNPDNESILEDIVQTLFLFEDREMIK      635
WP_001040106     562 KKLLDFLAKE--YEEFRIVDVIGLDKEhkAFNASLGTYHDLKKIL-DK DFLDNPDNESILEDIVQTLFLFEDREMIR      635
WP_001040107     562 KKLLDFLAKE--YEEFRIVDVIGLDKEhkAFNASLGTYHDLKKIL-DK DFLDNPDNESILEDIVQTLFLFEDREMIK      635
WP_001040108     562 KKLLDFLAKE--YEEFRIVDVIGLDKEhkAFNASLGTYHDLKKIL-DK DFLDNPDNESILEDIVQTLFLFEDREMIK      635
WP_001040109     562 KKLLDFLAKE--YEEFRIVDVIGLDKEhkAFNASLGTYHDLKKIL-DK DFLDNPDNESILEDIVQTLFLFEDREMIK      635
WP_001040110     562 KKLLDFLAKE--YEEFRIVDVIGLDKEhkAFNASLGTYHDLKKIL-DK DFLDNPDNESILEDIVQTLFLFEDREMIK      635
WP_015058523     563 KQLLDFLAKE--FEEFRIVDVTGLDKEhkAFNASLGTYHDLKKIL-GK DFLDNTDNELILEDIVQTLFLFEDREMIK      632
WP_017643650     562 KKLLDFLAKE--YEEFRIVDVIGLDKEhkAFNASLGTYHDLKKIL-DK DFLDNPDNESILEDIVQTLFLFEDREMIK      635
WP_017647151     562 KKLLDFLAKE--YEEFRIVDVIGLDKEhkAFNASLGTYHDLKKIL-DK DFLDNPDNESILEDIVQTLFLFEDREMIR      635
WP_017648376     562 KKLLDFLAKE--YEEFRIVDVIGLDKEhkAFNASLGTYHDLKKIL-DK DFLDNPDNESILEDIVQTLFLFEDREMIK      635
WP_017649527     562 KKLLDFLAKE--YEEFRIVDVIGLDKEhkAFNASLGTYHDLKKIL-DK DFLDNPDNESILEDIVQTLFLFEDREMIK      635
WP_017771611     562 KKLLDFLAKE--YEEFRIVDVIGLDKEhkAFNASLGTYHDLKKIL-DK DFLDNPDNESILEDIVQTLFLFEDREMIK      635
WP_017771984     562 KKLLDFLAKE--YEEFRIVDVIGLDKEhkAFNASLGTYHDLKKIL-DK DFLDNPDNESILEDIVQTITLFEDREMIK      635
CFQ25032         562 KKLLDFLAKE--YEEFRIVDVIGLDKEhkAFNASLGTYHDLKKIL-DK DFLDNPDNESILEDIVQTLFLFEDREMIK      635
CFV16040         562 KKLLDFLAKE--YEEFRIVDVIGLDKEhkAFNASLGTYHDLKKIL-DK DFLDNPDNESILEDIVQTLFLFEDREMIK      635
KLJ37842         562 KKLLDFLAKE--YEEFRIVDVIGLDKEhkAFNASLGTYHDLKKIL-DK DFLDNPDNESILEDIVQTLFLFEDREMIK      635
KLJ72361         563 KDIISELNK---VDGYEGIAIKGIEKQ---FNASLSTYHDLKKIL-GK DFLDNTDNELILEDIVQTLFLFEDREMIR      632
KLL20707         562 KKLLDFLAKE--YEEFRIVDVIGLDKEhkAFNASLGTYHDLKKIL-DK DFLDNPDNESILEDIVQTLFLFEDREMIK      635
KLL42645         562 KKLLDFLAKE--YEEFRIVDVIGLDKEhkAFNASLGTYHDLKKIL-DK DFLDNPDNESILEDIVQTLFLFEDREMIR      635
WP_047207273     562 KKLLDFLAKE--YEEFRIVDVIGLDKEhkAFNASLGTYHDLKKIL-DK DFLDNPDNESILEDIVQTLFLFEDREMIK      635
WP_047209694     563 KDIISELNK---VDGYEGIAIKGIEKQ---FNASLSTYHDLKKIL-GK DFLDNTDNELILEDIVQTLFLFEDREMIR      632
WP_050198062     562 KKLLDFLAKE--YEEFRIVDVIGLDKEhkAFNASLGTYHDLKKIL-DK DFLDNPDNESILEDIVQTLFLFEDREMIK      635
WP_050201642     562 KKLLDFLAKE--YEEFRIVDVIGLDKEhkAFNASLGTYHDLKKIL-DK DFLDNPDNESILEDIVQTLFLFEDREMIK      635
WP_050204027     562 KKLLDFLAKE--YEEFRIVDVIGLDKEhkAFNASLGTYHDLKKIL-DK DFLDNPDNESILEDIVQTLFLFEDREMIK      635
WP_050881965     562 KKLLDFLAKE--YEEFRIVDVIGLDKEhkAFNASLGTYHDLEKIL-DK DFLDNPDNESILEDIVQTLFLFEDREMIK      635
WP_050886065     562 KKLLDFLAKE--YEEFRIVDVIGLDKEhkAFNASLGTYHDLEKIL-DK DFLDNPDNESILEDIVQTLFLFEDREMIK      635
AHN30376         562 KQLLDFLAKE--FEEFRIVDVTGLDKEhkAFNASLGTYHDLKKIL-DK DFLDNPDNESILEDIVQTLFLFEDREMIK      635
```

```
EA078426          562 KKLLDFLAKE- -YEEEFRIVDVIGLDKEmkAFNASLGTYHDLLEKIL-DK DFLDNPDNESILEDIVQTLTLFEDREMIK        635
CCW42055          562 KQLLDFLAKE- -FEEEFRIVDVTGLDKEmkAFNASLGTYHDLLEKIL-GK DFLDNPDNESILEDIVQTLTLFEDREMIK        635
WP_003041502      561 DKLLNYLNKE- -FEEEFRIVNLTGLDKEmkVENSSLGTYHDLRKIL-NK SFLDNKENAQIIEDIIQTLTLFEDREMIR        634
WP_037593752      562 DKLLNYLNKE- -FEEEFRIVNLTGLDKEmkAENSSLGTYHDLRKIL-DK SFLDNKANEKTIEDIIQTLTLFEDREMIR        635
WP_049516684      562 DKLLNYLNKE- -FEEEFRIVNLTGLDKEmkAFNASLGTYHDLRKIL-DK SFLDDKVNEKIIEDIIQTLTLFEDREMIR        635
GAD46167          561 EKLLNYLDKE- -FPEYRIQDLVGLDKEmkSFNASLGTYHDLKKIL-DK SFLDDKVNEVIEDIIKTLTLFEDREMIQ        634
WP_018363470      572 KQLKEDYFKK- -IECEDSVEIIGVEDR- ---FNASLGTYHDLLKIIKDK DFLDNEENEDILEDIVLTLTLFEDKEMIE        643
WP_003043819      561 DKLLNYLNKE- -FEEEFRIVNLTGLDKEmkAENSSLGTYHDLRKIL-DK SFLDDKANEKTIEDIIQTLTLFEDREMIR        634
WP_006269658      561 DKLLNYLDKE- -FEEEFRIVNLTGLDKEmkAFNASLGTYHDLRKIL-DK SFLDDKANEKTIEDIIQTLTLFEDKEMIE        634
WP_048800889      562 KQLKEDYFKK- -IECEDSVEISGVEDR- ---FNASLGTYHDLLKIIKDK DFLDNEENEDILEDIVLTLTLFEDKEMIE        634
WP_012767106      562 KQLKEDYFKK- -IECEDSVEISGVEDR- ---FNASLGTYHDLLKIIKDK DFLDNEENEDILEDIVLTLTLFEDKEMIE        633
WP_014612333      562 KQLKEDYFKK- -IECEDSVEISGVEDR- ---FNASLGTYHDLLKIIKDK DFLDNEENEDILEDIVLTLTLFEDKEMIE        633
WP_015017095      562 KQLKEDYFKK- -IECEDSVEISGVEDR- ---FNASLGTYHDLLKIIKDK DFLDNEENEDILEDIVLTLTLFEDKEMIE        633
WP_015057649      562 KQLKEDYFKK- -IECEDSVEISGVEDR- ---FNASLGTYHDLLKIIKDK DFLDNEENEDILEDIVLTLTLFEDKEMIE        633
WP_048327215      562 KQLKEDYFKK- -IECEDSVEISGVEDR- ---FNASLGTYHDLLKIIKDK DFLDNEENEDILEDIVLTLTLFEDKEMIE        633
WP_049519324      562 KQLKENYFKK- -IECEDSVEISGVEDR- ---FNASLGTYHDLLKIIKDK DFLDNPDNQKIIEDIILTLTLFEDKKMIS        633
WP_012515931      562 KQLKENYFKK- -IECWDSVEITGVEDS- ---FNASLGTYHDLLKIIQDK DFLDNPDNQKIIEDIILTLTLFEDKKMIS        633
WP_021320964      562 KQLKENYFKK- -IECWDSVEITGVEDS- ---FNASLGTYHDLLKIIQDK DFLDNPDNQKIIEDIILTLTLFEDKKMIS        633
WP_037581760      561 AKLLSYLNNE- -FEEEFRINDLIGLDGSkFNASLGTYHDLKKKIL-DK SFLDDKTNEQIIEDIVLTLTLFEDRDMIH        634
WP_004232481      562 EKLLNYLNKE- -FPEYRIKDLIGLDKEnkSFNASLGTYHDLKKIL-DK SFLDDKTNETIIEDIIQTLTLFEDRDMIR        635
WP_009854540      562 DKPLNYLNKE- -FPEYRIQDLIGLDKEnkSFNASLGTYHDLKKIL-DK AFLDDKVNEEVIEDIIKTLTLFEDKDMIH        635
WP_012962174      564 AKLLSYLNNE- -FEEEFRINDLIGLDKDsKFNASLGTYHDLKKIL-DK AFLDDKVNEEVIEDIVLTLTLFEDKDMIH        637
WP_039695303      561 KQLKEEYESK- -MKCFHTVTILGVEDR- ---FNASLGTYHDLLKFKDK AFLDDEANQDILEEIVWTLTLFEDQAMIE        634
WP_003099269      562 KQLKEEYESK- -MKCFHTVTILGVEDR- ---FNASLGTYHDLLKFKDK AFLDDEANQDILEEIVWTLTLFEDQAMIE        633
AHY15608          562 KQLKEEYESK- -MKCFHTVTILGVEDR- ---FNASLGTYHDLLKFKDK AFLDDEANQDILEEIVWTLTLFEDQAMIE        633
AHY17476          562 KQLKEEYESK- -MKCFHTVTILGVEDR- ---FNASLGTYHDLLKFKDK AFLDDEANQDILEEIVWTLTLFEDQAMIE        633
ESR09100          --- ---------- ------------------ ------------------ ----------------------------        ---
AGM98575          562 KQLKEEYESK- -MKCFHTVTILGVEDR- ---FNASLGTYHDLLKFKDK AFLDDEANQDILEEIVWTLTLFEDQAMIE        633
ALF27331          561 DKLMDFLEKE- -FDEFRIVDLTGLDKEnkAFNASYGTYHDLRKIL-DK DFLDNSKNEKILEDIVLTLTLFEDREMIR        634
WP_018372492      574 RKLKDFIEKElgYGYIDIDnkIKGVEEQ- ---FNASYTTYQDLLKIIGDK EFLDDKVNEENKDLLEEIIYILTVFEDRKMIE        647
WP_045618028      563 KDIIQYLHN-- -VDSYDGIELKGIEKQ- ---FNASLSTYHDLLKIIKDK EFMDDSKNEAILENIVHTLTIFEDREMIK        633
WP_045635197      562 KDIIHYLHN-- -VDSYDGIELKGIEKQ- ---FNASLSTYHDLLKIIKDK EFMDDAKNEAILENIVHTLTIFEDREMIK        632
WP_002263549      561 DKLMDFLEKE- -FDEFRIVDLTGLDKEnkVFNASYGTYHDLCKIL-DK DFLDNSKNEKILEDIVLTLTLFEDREMIR        634
WP_002263887      561 DKLMDFLEKE- -FDEFRIVDLTGLDKEnkVFNASYGTYHDLCKIL-DK DFLDNSKNEKILEDIVLTLTLFEDREMIR        634
WP_002264920      561 DKLMDFLEKE- -FDEFRIVDLTGLDKEnkAFNASYGTYHDLCKIL-DK DFLDNSKNEKILEDIVLTLTLFEDREMIR        634
WP_002269043      561 DKLMDFLEKE- -FDEFRIVDLTGLDKEnkAFNASYGTYHDLCKIL-DK DFLDNSKNEKILEDIVLTLTLFEDREMIR        634
WP_002269448      561 DKLMDFLEKE- -FDEFRIVDLTGLDKEnkAFNASYGTYHDLCKIL-DK DFLDNSKNEKILEDIVLTLTLFEDREMIR        634
WP_002271977      561 DKLMDFLEKE- -FDEFRIVDLTGLDKEnkAFNASYGTYHDLCKIL-DK DFLDNSKNEKILEDIVLTLTLFEDREMIR        634
WP_002272766      561 DKLMDFLEKE- -FDEFRIVDLTGLDKEnkAFNASYGTYHDLCKIL-DK DFLDNSKNEKILEDIVLTLTLFEDREMIR        634
WP_002273241      561 DKLMDFLEKE- -FDEFRIVDLTGLDKEnkAFNASYGTYHDLCKIL-DK DFLDNSKNEKILEDIVLTLTLFEDREMIR        634
WP_002275430      561 DKLMDFLEKE- -FDEFRIVDLTGLDKEnkAFNASYGTYHDLCKIL-DK DFLDNSKNEKILEDIVLTLTLFEDREMIR        634
WP_002276448      561 DKLMDFLEKE- -FDEFRIVDLTGLDKEnkAFNASYGTYHDLCKIL-DK DFLDNSKNEKILEDIVLTLTLFEDREMIR        634
WP_002277050      561 KKLRTFLDKN- -FDEFRIVDIQGLDKEteTENASYATYQDLLKVIKDK VFMDNPENAEILENIVLTLTLFEDREMIR        635
WP_002277364      561 DKLMDFLEKE- -FDEFRIVDLTGLDKEnkAFNASYGTYHDLCKIL-DK DFLDNSKNEKILEDIVLTLTLFEDREMIR        634
WP_002279025      561 DKLMDFLEKE- -FDEFRIVDLTGLDKEnkAFNASYGTYHDLCKIL-DK DFLDNSKNEKILEDIVLTLTLFEDREMIR        634
WP_002279859      561 DKLMDFLEKE- -FDEFRIVDLTGLDKEnkAFNASYGTYHDLCKIL-DK DFLDNSKNEKILEDIVLTLTLFEDREMIR        634
WP_002280230      561 DKLMDFLEKE- -FDEFRIVDLTGLDKEnkAFNASYGTYHDLRKIL-DK DFLDNSKNEKILEDIVLTLTLFEDREMIR        634
WP_002281696      561 DKLMDFLEKE- -FDEFRIVDLTGLDKEnkAFNASYGTYHDLRKIL-DK DFLDNSKNEKILEDIVLTLTLFEDREMIR        634
WP_002282247      561 KKLRTFLDKN- -FDEFRIVDIQGLDKEteTENASYATYQDLLKVIKDK VFMDNPENAEILENIVLTLTLFEDREMIR        635
WP_002282906      561 DKLMDFLEKE- -FDEFRIVDLTGLDKEnkAFNASYGTYHDLRKIL-DK DFLDNSKNEKILEDIVLTLTLFEDREMIR        634
WP_002283846      561 DKLMDFLEKE- -FDEFRIVDLTGLDKEnkAFNASYGTYHDLRKIL-DK DFLDNSKNEKILEDIVLTLTLFEDREMIR        634
WP_002287255      561 DKLMDFLEKE- -FDEFRIVDLTGLDKEnkAFNASYGTYHDLRKIL-DK DFLDNSKNEKILEDIVLTLTLFEDREMIR        634
```

-continued

| | | | | |
|---|---|---|---|---|
| WP_002288990 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_002289641 | 561 | DKLMDFLEKE--FDEFRIVDLTGLDKEhkAFNASYGTYHDLCKIL-DK | DFLDNSKNEKILEDIVLTLTLFEDREMIR | 634 |
| WP_002290427 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_002295753 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_002296423 | 561 | DKLMDFLEKE--FEEFRIVDLTGLDKEhkVENSSLGTYHDLCKIL-DK | DFLDNSKNEKILEDIVLTLTLFEDREMIR | 634 |
| WP_002304487 | 571 | DKLINYLNKE--FEEFRIVNLTGLDKEhkVENSSLGTYHDLCKIL-NK | SFLDNKENEQIIEDIQTLTLFEDREMIR | 644 |
| WP_002305844 | 561 | DKLMDFLEKE--FDEFRIVDLTGLDKEhkVFNASYGTYHDLCKIL-DK | DFLDNSKNEKILEDIVLTLTLFEDREMIR | 634 |
| WP_002307203 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_002310390 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_002352408 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_012997688 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_014677909 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_019312892 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_019313659 | 561 | DKLMDFLEKE--FDEFRIVDLTGLDKEhkVFNASYGTYHDLCKIL-DK | DFLDNSKNEKILEDIVLTLTLFEDREMIR | 634 |
| WP_019314093 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_019315370 | 561 | DKLMDFLEKE--FDEFRIVDLTGLDKEhkAFNASYGTYHDLCKIL-DK | DFLDNSKNEKILEDIVLTLTLFEDREMIR | 634 |
| WP_019803776 | 561 | DKLMDFLEKE--FDEFRIVDLTGLDKEhkVFNASYGTYHDLCKIL-DK | DFLDNSKNEKILEDIVLTLTLFEDREMIR | 634 |
| WP_019805234 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_024783594 | 561 | DKLMDFLEKE--FDEFRIVDIQGLDKEtETFNASYATYQDLLKVIDK | VFMDNPENAEILENIVLTLTLFEDREMIK | 635 |
| WP_024784288 | 561 | KKLRTFLDKN--FDEFRIVDIQGLDKEtETFNASYATYQDLLKVIDK | VFMDNPENAEILENIVLTLTLFEDREMIK | 635 |
| WP_024784666 | 561 | DKLMDFLEKE--FDEFRIVDLTGLDKEhkAFNASYGTYHDLRKIL-DK | DFLDNSKNEKILEDIVLTLTLFEDREMIR | 634 |
| WP_024784894 | 561 | DKLMDFLEKE--FDEFRIVDLTGLDKEhkAFNASYGTYHDLCKIL-DK | DFLDNSKNEKILEDIVLTLTLFEDREMIR | 634 |
| WP_024786433 | 561 | KKLRTFLDKN--FDEFRIVDIQGLDKEtETFNASYATYQDLLKVIDK | VFMDNPENAEILENIVLTLTLFEDREMIK | 635 |
| WP_049473442 | 561 | DKLMDFLEKE--FDEFRIVDLTGLDKEhkVFNASYGTYHDLCKIL-DK | DFLDNSKNEKILEDIVLTLTLFEDREMIR | 634 |
| WP_049474547 | 554 | DKLMDFLEKE--FDEFRIVDLTGLDKEhkAFNASYGTYHDLRKIL-DK | DFLDNSKNEKILEDIVLTLTLFEDREMIR | 627 |
| EMC03581 | 565 | KDIIQYLHT---VDGYDGIELKGIEKQ---FNASLSTYHDLLKIIKDK | EFMDDPNNEEILENIVHTLTIFEDREMIK | 635 |
| WP_000428612 | 563 | KDIIQFLHN---VDGYDGIELKGIEKQ---FNASLSTYHDLLKIIKDK | EFMDDSKNEILENITLTIFEDREMIK | 633 |
| WP_000428613 | 562 | KDIIHYLHN---VDGYDGIELKGIEKH---FNSLSTYHDLLKIIKDK | EFMDDPKQNEILENIVHTLTIFEDRVMIK | 632 |
| WP_049523028 | 531 | KQLKENYFNK--IRCLDSITISGVEDK---FNASLGTYHDLLNIIKNQ | KILLDDEQNQDSLEDIVLTLTLFEDEKMIA | 602 |
| WP_003107102 | 564 | WP_KEDFFSK--IECFDTVDISGVEDK---FNASLGTYHDLLKIIKDK | AFLDNSENENIIEDIILTLTLFEDREMIA | 635 |
| WP_054279288 | 563 | KDLIHYLHN---VDGYDGIELKGIEKQ---FNASLSTYHDLLKIIKDK | RFMDEPKNQEILENIVHTLTIFEDREMIK | 633 |
| WP_049531101 | 563 | KDIIQYLHN---VDGYDGIELKGIEKQ---FNASLSTYHDLLKIIKDK | EFMDDSKNEILENIVHTLTIFEDREMIK | 633 |
| WP_049538452 | 565 | KDIIHYLHT---VDGYDGIELKGIEKQ---FNASLSTYHDLLKIIKDK | EFMDDSKNEAILENIVHTLTIFEDREMIK | 636 |
| WP_049549711 | 517 | KDLKEKYFSQ--IEGLENVDVTGVEGA---FNALSLSTYHDLLKIIKDK | AFLDEANAEILEEIVLLLTLFQDEKLIE | 588 |
| WP_007896501 | 562 | KDIIHYLHN---VDGYDGIELKGIEKQ---FNASLSTYHDLLKIIKDK | EFMDDPKQNEILENIVHTLTIFEDREMIK | 632 |
| EFR44625 | 517 | KDLKEKYFSQ--IEGLENVDVTGVEGA---FNALSLSTYHDLLKIIKDK | AFLDEANAEILEEIVLLLTLFQDEKLIE | 588 |
| WP_002897477 | 562 | KDIIHYLHN---VDGYDGIELKGIEKQ---FNASLSTYHDLLKIIKDK | EFMDDPKQNEILENIVHTLTIFEDREVMIK | 632 |
| WP_002906454 | 563 | KDIIQFLHN---VDGYDGIELKGIEKQ---FNASLSTYHDLLKIIKDK | EFMDNPKQNEILENIIHTLTIFEDREMIK | 633 |
| WP_009729476 | 636 | KKILNFLDKN--PDEFRITDIQGLDNEtgNENASYGTYHDLLKIIGDK | AFMDAKNEAILENIVHTLTIFEDREMIK | 636 |
| CQR24647 | 564 | KDLIHYLHN---VDGYDGIELKGIEKQ---FNASLSTYHDLLKIIKDK | EFMDSSDNVDVLEDIVLSLTLFEDREMIK | 635 |
| WP_000066813 | 563 | KDIIHYLHN---VDGYDGIELKGIEKQ---FNASLSTYHDLLKIIKDK | AFMDDSKNEILENIIHTLTIFEDREMIK | 635 |
| WP_009754323 | 563 | KDIIHYLHN---VDGYDGIELKGIEKQ---FNASLSTYHDLLKIIKDK | EFMDNHKNQEILENIVHTLTIFEDREMIK | 634 |
| WP_044674937 | 562 | KDIKAYL-EN--SNGYAGVELKGLEEQ---FNASLPTYHDLLKIIRDK | AFIDAEENQEILEDIVLTLTLFEDREMIK | 634 |
| WP_044676715 | 561 | EKLMDFLGKE--PDEFRIVDLLGLDKDnkSFNASLGTYHDLKKIV-SK | DLLDNPENEDILENVVLTLTLFEDREMIR | 634 |
| WP_044680361 | 562 | EKLMDFLGKE--PDEFRIVDLLGLDKDnkSFNASLGTYHDLKKIV-SK | DLLDNPENEDILENVVLTLTLFEDREMIR | 634 |
| WP_044681799 | 562 | KDIKAYL-EN--SNGYAGVELKGLEEQ---FNASLPTYHDLLKIIRDK | AFIDAEENQEILEDIVLTLTLFEDREMIR | 634 |
| WP_049533112 | 541 | DKLLNYLGKE--FDEFRIVDLTGLDKEnkVENSSLGTYHDLRKIL-DR | SFLDNKENEQIIEDIQTLTLFEDREMIR | 612 |
| WP_029090905 | 568 | TSLKKWLAEH--EHMTVSVVQGTQKEt-EFATSLQAEHREVKIF-DR | ETVSNPANEMFEKIIYWSTVFEDKKIMR | 637 |
| WP_006506696 | 568 | KKLKNWLVNNgcCS--KDAEIKGFQKEh-QESTSLTPWIDETNIFGKI | ---DQSNFDLIENIIYDLTVFEDKKIMK | 637 |
| AIT42264 | 562 | KQLKEDYFKK--IECEDSVEISGVEDR---FNSNYSTYIDLSKIPDMK | DFLDNEENEDILENIVLTLTILFEDREMIE | 633 |
| WP_034440723 | 568 | NQLVKYIENK--EQIIAPEIKGIEDS---FNSNYSTYIDLSKIPDMK | -LLEKDEDEILEEIIKILTIFEDRKMRK | 637 |
| AKQ21048 | 562 | KQLKEDYFKK--IECEDSVEISGVEDR---FNASLGTYHDLLKIIKDK | DFLDNEENEDILENVVLTLTLFEDREMIE | 633 |
| WP_004636532 | 563 | KDIANYLEQ---YGYVDGTDIKGVEDK---FNASLSTYNDLAKIDGAK | AYLDDPEYADVWEDIIKILTIFEDKAMRK | 633 |

| | | | |
|---|---|---|---|
| WP_002364836 | 570 | KDIIQFYRNE--YN-TEIVTLSGLEED--QFNASFSTYQDLLKCGLTR | AELDHPDNAEKLEDIIKILTIFEDRQRIR | 641 |
| WP_016631044 | 521 | KDIIQFYRNE--YN-TEIVTLSGLEED--QFNASFSTYQDLLKCGLTR | AELDHPDNAEKLEDIIKILTIFEDRQRIR | 592 |
| EMS75795 | 306 | KKLQQFLSAN--YN-IEDAEILGVDKA--FNSSYATYHDFLDLAKPN | ELLEQPEMNAMFEDIVKILTIFEDREMIR | 381 |
| WP_002373311 | 570 | KDIIQFYRNE--YN-TEIVTLSGLEED--QFNASFSTYQDLLKCGLTR | AELDHPDNAEKLEDIIKILTIFEDRQRIR | 641 |
| WP_002378009 | 570 | KDIIQFYRNE--YN-TEIVTLSGLEED--QFNASFSTYQDLLKCGLTR | AELDHPDNAEKLEDIIKILTIFEDRQRIR | 641 |
| WP_002407324 | 570 | KDIIQFYRNE--YN-TEIVTLSGLEED--QFNASFSTYQDLLKCGLTR | AELDHPDNAEKLEDIIKILTIFEDRQRIR | 641 |
| WP_002413717 | 570 | KDIIQFYRNE--YN-TEIVTLSGLEED--QFNASFSTYQDLLKCGLTR | AELDHPDNAEKLEDIIKILTIFEDRQRIR | 641 |
| WP_010775580 | 572 | KDIIQFYRNE--YN-TEIVTLSGLEED--QFNASFSTYQDLLKCGLTR | AELDHPDNAEKLEDIIKILTIFEDRQRIR | 643 |
| WP_010818269 | 570 | KDIIQFYRNE--YN-TEIVTLSGLEED--QFNASFSTYQDLLKCGLTR | AELDHPDNAEKLEDIIKILTIFEDRQRIR | 641 |
| WP_010824395 | 570 | KDIIQFYRNE--YN-TEIVTLSGLEED--QFNASFSTYQDLLKCGLTR | AELDHPDNAEKLEDIIKILTIFEDRQRIR | 641 |
| WP_016622645 | 570 | KDIIQFYRNE--YN-TEIVTLSGLEED--QFNASFSTYQDLLKCGLTR | AELDHPDNAEKLEDIIKILTIFEDRQRIR | 641 |
| WP_033624816 | 570 | KDIIQFYRNE--YN-TEIVTLSGLEED--QFNASFSTYQDLLKCGLTR | AELDHPDNAEKLEDIIKILTIFEDRQRIR | 641 |
| WP_033625576 | 570 | KDIIQFYRNE--YN-TEIVTLSGLEED--QFNASFSTYQDLLKCGLTR | AELDHPDNAEKLEDIIKILTIFEDRQRIR | 641 |
| WP_033789179 | 570 | KDIIQFYRNE--YN-TEIVTLSGLEED--QFNASFSTYQDLLKCGLTR | AELDHPDNAEKLEDIIKILTIFEDRQRIR | 641 |
| WP_002310644 | 567 | KDLQEFLYLK--YD-IKHAELSGIEKA--FNASYTTYHDFLTMSENK | QWLEDPELASMFEEIIKTLTVFEDREMIK | 638 |
| WP_002312694 | 568 | KDLQEFLYLK--YD-IKHAELSGIEKA--FNASYTTYHDFLTMSENK | QWLEDPELASMFEEIIKTLTVFEDREMIK | 642 |
| WP_002314015 | 568 | KDLQEFLYLK--YD-IKHAELSGIEKA--FNASYTTYHDFLTMSENK | QWLEDPELASMFEEIIKTLTVFEDREMIK | 642 |
| WP_002320716 | 568 | KDLQEFLYLK--YD-IKHAELSGIEKA--FNASYTTYHDFLTMSENK | QWLEDPELASMFEEIIKTLTVFEDREMIK | 642 |
| WP_002330729 | 567 | KDLQEFLYLK--YD-IKHAELSGIEKA--FNASYTTYHDFLTMSENK | QWLEDPELASMFEEIIKTLTVFEDREMIK | 641 |
| WP_002335161 | 568 | KDLQEFLYLK--YD-IKHAELSGIEKA--FNASYTTYHDFLTMSENK | QWLEDPELASMFEEIIKTLTVFEDREMIK | 642 |
| WP_002345439 | 568 | KDLQEFLYLK--YD-IKHAELSGIEKA--FNASYTTYHDFLTMSENK | QWLEDPELASMFEEIIKTLTVFEDREMIK | 642 |
| WP_034867970 | 562 | KKLQNFLYTH--YH-IENAQIFGIEKA--FNASYSTYHDFMKLAKTN | EWLEQPEMEPIFEDIVKILTIFEDRQMIK | 637 |
| WP_047937432 | 568 | KDLQEFLYLK--YD-IKHAELSGIEKA--FNASYTTYHDFLTMSENK | QWLEDPELASMFEEIIKTLTVFEDREMIK | 642 |
| WP_010720994 | 562 | KKLQNFLYTH--YH-IENAQIFGIEKA--FNASYSTYHDFMKLAKTN | EWLEQPEMEPIFEDIVKILTIFEDRQMIK | 637 |
| WP_010737004 | 562 | KKLQNFLYTH--YH-IENAQIFGIEKA--FNASYSTYHDFMKLAKTN | EWLEQPEMEPIFEDIVKILTIFEDRQMIK | 637 |
| WP_034700478 | 562 | KKLQNFLYTH--YH-IENAQIFGIEKA--FNASYSTYHDFMKLAKTN | EWLEQPEMEPIFEDIVKILTIFEDRQMIK | 637 |
| WP_007209003 | 564 | KKLENYLRIE1---SISSPSVKGIEEQ--FNANFGTYLDLKKFDELH | PYLDDEKYQDTLEEVIKVLTVFEDRSMIQ | 634 |
| WP_023519017 | 560 | KQLRKFLELN--EQ-IDSTEIKGIETS--FNASYSTYHDLLKLS--- | TLLDDPMTTMFEEIIKILTVFEDREMIR | 631 |
| WP_010770040 | 564 | KLIEKFLSNE--FG-LVDVAIKGIE-T--SFNAGYGTYHDFLKIGITR | EQLDKEENSETLBEIVKILTVFEDRKMIR | 634 |
| WP_048604708 | 560 | KDLSNFLRNE--YN-LDDVIIDGIE-N--KFNASFNTYHDFLKLKIDP | KVLDDPANEPMFEEIVKILTIFEDRKMLR | 630 |
| WP_010750235 | 601 | KKLQHFLSAN--YD-IECDFSVEISGVEDR--FNSSYATYHDFLELAKPY | ELLEQPEMEEMFEDIVLITLFEDREMVR | 636 |
| AII16583 | 601 | KQLKEDYFKK--IECFDSVEISGVEDR--ACSTSLTPWIDFTKIFGEI | DFLDNEENEDILEDIVLITLFEDREMVR | 672 |
| WP_029073316 | 576 | NAMKKWLVKNqyFSNTDDIKIEGFQKEn--ACSTSLTPWIDFTKIFGKI | ----NNSNVELIEKIIYDVTVFEDKKILR | 647 |
| WP_031589969 | 576 | NAMKKWLVKNqyFSNTDDIKIEGFQKEn--ACSTSLTPWIDFTKIFGKI | ----NESNYDFIEKIIYDVTVFEDKKILR | 647 |
| KDA45870 | 558 | KMVIKHLKVV--MPAIRIQALKGLDNGk--FNASYGTYKDLVDMGVAP | ELLNDEVNSEKWEDIIKLLTIFEGRKLIK | 630 |
| WP_039099354 | 579 | KNIQDYLVSEk--RYASRPAITGLSDEnk--FNSRLSTYHDLKTIVGDA | -VDDVDKQADLEKCIEWSTIFEDGKIYS | 650 |
| AKP02966 | 561 | KKLTKWLIAQg---YYKNPILIGLSQKq--EFNSTLTTYLDMKKIFGSS | -FMENNKNYNQIELIEWLTIFEDKQILN | 632 |
| WP_010991369 | 567 | KDLELFLRNM--SH-VESPTIEGLE-D--SFNNSYSTYHDLLKVGIKQ | EIILDNPVNTEMLENIVKILTVFEDKRMIK | 637 |
| WP_033838504 | 567 | KDLELFLRNM--SH-VESPTIEGLE-D--SFNNSYSTYHDLLKVGIKQ | EIILDNPVNTEMLENIVKILTVFEDKRMIK | 637 |
| EHN60060 | 570 | KDLELFLRNM--SH-VESPTIEGLE-D--SFNNSYSTYHDLLKVGIKQ | EIILDNPVNTEMLENIVKILTVFEDKRMIK | 640 |
| EFR89594 | 336 | KDLELFLRNI--SH-IESPTIEGLE-D--SFNSSYSTYHDLLKVGIKQ | EIILDNPVNTEMLENIVKILTVFEDKRMIK | 406 |
| WP_038409211 | 567 | KDLERFLYTI--NH-IESPTIEGVE-D--AFNSSFATYHDLLQKGGVTQ | EIILDNPLNADMLEBEIVKILTVFEDKRMIK | 637 |
| EFR95520 | 186 | KDLERFLYTI--NH-IESPTIEGVE-D--AFNSSFATYHDLLQKGGVTQ | EIILDNPLNADMLEBEIVKILTVFEDKRMIK | 256 |
| WP_003723650 | 567 | KDLELFLRNI--NH-IESPTIEGLE-D--SFNASYATYHDLLKVGMKQ | EIILDNPLNTEMLEDIVKILTVFEDKRMIK | 637 |
| WP_003727705 | 567 | KDLELFLRNI--NH-IESPTIEGLE-D--SFNASYATYHDLLKVGLKQ | EIILDNPLNTEILEDIVKILTVFEDKRMIK | 637 |
| WP_003730785 | 567 | KDLELFLRNI--NH-IESPTIEGLE-D--SFNASYATYHDLLKVGLKQ | EIILDNPLNTEILEDIVKILTVFEDKRMIK | 637 |
| WP_003733029 | 567 | KDLELFLRNI--NQ-IESPTIEGLE-D--SFNASYATYHDLLKVGMKQ | EIILDNPVNTEMLENIVKILTVFEDKRMIK | 637 |
| WP_003739838 | 567 | KDLEQFLRNM--SH-IESPTIEGLE-D--SFNNSYSTYHDLLKVGIKQ | EVLENPLNTEMLEDIVKILTVFEDKRMIK | 637 |
| WP_014601172 | 567 | KDLELFLRNI--NH-IESPTIEGLE-D--SFNASYATYHDLLKVGMKQ | EIILDNPVNTEMLENIVKILTVFEDKRMIK | 637 |
| WP_023548323 | 567 | KDLELFLRNI--NQ-IESPTIEGLE-D--SFNASYATYHDLLKVGMKQ | EIILDNPLNTEMLEDIVKILTVFEDKRMIK | 637 |
| WP_031665337 | 567 | KDLELFLRNI--NH-IESPTIEGLE-D--SFNASYATYHDLMKVGMKQ | EIILDNPLNTEMLEDIVKILTVFEDKRMIK | 637 |
| WP_031669209 | 567 | KDLELFLRNI--NH-IESPTIEGLE-D--SFNASYATYHDLMKVGMKQ | EIILDNPLNTEMLEDIVKILTVFEDKRMIK | 637 |
| WP_033920898 | 567 | KDLELFLRNI--NH-VESPTIEGLE-D--SFNASYATYHDLMKVGIKQ | EIILDNPLNTEMLEDIVKILTVFEDKRMIK | 637 |

-continued

| | | | |
|---|---|---|---|
| AKI42028 | 570 KDLELFLRNI--NH-IESPTIEGLE-D---SFNASYATYHDLLKVGMKQ EILDNPLNTEMLEDIVKILTVFEDKPMIK | 640 |
| AKI50529 | 570 KDLELFLRNI--NH-VESPTIEGLE-D---SFNASYATYHDLMKVGIKQ EILDNPLNTEMLEDIVKILTVFEDKRMIK | 640 |
| EFR83390 | 15 KDLELFLRNI--NQ-IESPTIEGLE-D---SFNASYATYHDLLKVGMKQ EILDNPLNTEMLEDIVKILTVFEDKRMIK | 85 |
| WP_046323366 | 567 KDLELFLYNM--NH-VESPTVEGVE-D---AFNSSETTYHDLQKVGVPQ EILDDPLNTEMLEEIKILTVFEDKRMIN | 637 |
| AKE81011 | 578 KQLKEDYFKK--IECEDSVEISGVEDR----FNASLGTYHDLLKIIKDK DFLDNEENEDILEDIVLTLTLFEDREMIE | 649 |
| CUO82355 | 572 KKLKNWLVNNqcCR--KDAEIKGFQKER-QESTSLTPWIDETNIFGKI ----DQSNFDLIEKIIYDLTVFEDKKIMK | 641 |
| WP_033162887 | 573 KKLKDWLVTHqyYDINEELKIEGYQKDI-QESTSLAPWIDETKIFGEI ----NASNYQLIEKIIYDISIFEDKKILK | 644 |
| AGZ01981 | 595 KQLKEDYFKK--IECEDSVEISGVEDR----FNASLGTYHDLLKIIKDK DFLDNEENEDILEDIVLTLTLFEDREMIE | 666 |
| AKA60242 | 562 KQLKEDYFKK--IECEDSVEISGVEDR----FNASLGTYHDLLKIIKDK DFLDNEENEDILEDIVLTLTLFEDREMIE | 633 |
| AKS40380 | 562 KQLKEDYFKK--IECEDSVEISGVEDR----FNASLGTYHDLLKIIKDK DFLDNEENEDILEDIVLTLTLFEDREMIE | 633 |
| 4UN5_B | 566 KQLKEDYFKK--IECEDSVEISGVEDR----FNASLGTYHDLLKIIKDK DFLDNEENEDILEDIVLTLTLFEDREMIE | 637 |
| WP_010922251 | 634 ERLKTYAHLFDDKVMKQLKR-RRYTGWGRLSRKLINGIRDK QSGKTILDFLK -DGf---ANRNFMQLIHDDSL | 702 |
| WP_039695303 | 638 ERLQKYSDIFTANQLKKLER-RHYTGWGRLSYKLINGIRNK ENNKTILDYLI DDG---SANRNFMQLINDDTL | 706 |
| WP_045635197 | 633 QRLAQYDSLFDEKVIKALTR-RHYTGWGKLSAKLINGICDK QTGNTILDYLI DDG---KINRNFMQLINDDGL | 701 |
| 5AXW_A | 369 EELTNLNSELTQEEIEQISN1KGYTGTHNLSLKAINLILDE -------LW ------TNDNQIAIFNRLKL | 426 |
| WP_009880683 | 318 ERLKTYAHLFDDKVMKQLKR-RRYTGWGRLSRKLINGIRDK QSGKTILDFLK -DGf---ANRNFMQLIHDDSL | 386 |
| WP_010922251 | 634 ERLKTYAHLFDDKVMKQLKR-RRYTGWGRLSRKLINGIRDK QSGKTILDFLK -DGf---ANRNFMQLIHDDSL | 702 |
| WP_011054416 | 634 ERLKTYAHLFDDKVMKQLKR-RRYTGWGRLSRKLINGIRDK QSGKTILDFLK -DGf---ANRNFMQLIHDDSL | 702 |
| WP_011284745 | 634 ERLKTYAHLFDDKVMKQLKR-RRYTGWGRLSRKLINGIRDK QSGKTILDFLK -DGf---ANRNFMQLIHDDSL | 702 |
| WP_011285506 | 634 ERLKTYAHLFDDKVMKQLKR-RRYTGWGRLSRKLINGIRDK QSGKTILDFLK -DGf---ANRNFMQLIHDDSL | 702 |
| WP_011527619 | 634 ERLKTYAHLFDDKVMKQLKR-RRYTGWGRLSRKLINGIRDK QSGKTILDFLK -DGf---ANRNFMQLIHDDSL | 702 |
| WP_012560673 | 634 ERLKTYAHLFDDKVMKQLKR-RRYTGWGRLSRKLINGIRDK QSGKTILDFLK -DGf---ANRNFMQLIHDDSL | 702 |
| WP_014407541 | 634 ERLKTYAHLFDDKVMKQLKR-RRYTVWGRLSRKLINGIRDK QSGKTILDFLK -DGf---ANRNFMQLIHDDSL | 702 |
| WP_020905136 | 634 ERLKTYAHLFDDKVMKQLKR-RRYTGWGRLSRKLINGIRDK QSGKTILDFLK -DGf---ANRNFMQLIHDDSL | 702 |
| WP_023080005 | 634 ERLKTYANLFDDKVMKQLKR-RHYTGWGRLSAKLINGICDK QSGKTILDFLK -DGf---ANRNFMQLIHDDSL | 702 |
| WP_023610282 | 634 ERLKKYANLFDDKVMKQLKR-RHYTGWGRLSAKLINGIRDK QSGKTILDFLK -DGf---ANRNFMQLIHDDSL | 702 |
| WP_030125963 | 634 ERLKTYAHLFDDKVMKQLKR-RRYTGWGRLSRKLINGIRDK QSGKTILDFLK -DGf---ANRNFMQLIHDDSL | 702 |
| WP_030126706 | 634 ERLKTYAHLFDDKVMKQLKR-RRYTGWGRLSRKLINGIRDK QSGKTILDFLK -DGf---ANRNFMQLIHDDSL | 702 |
| WP_031488318 | 634 ERLKTYAHLFDDKVMKQLKR-RRYTGWGRLSRKLINGIRDK QSGKTILDFLK -DGf---ANRNFMQLIHDDSL | 702 |
| WP_032460140 | 634 ERLKTYAHLFDDKVMKQLKR-RRYTGWGRLSRKLINGIRDK QSGKTILDFLK -DGf---ANRNFMQLIHDDSL | 702 |
| WP_032461047 | 634 ERLKTYAHLFDDKVMKQLKR-RRYTGWGRLSRKLINGIRDK QSGKTILDFLK -DGf---ANRNFMQLIHDDSL | 702 |
| WP_032462016 | 634 ERLKTYAHLFDDKVMKQLKR-RRYTGWGRLSRKLINGIRDK QSGKTILDFLK -DGf---ANRNFMQLIHDDSL | 702 |
| WP_032462936 | 634 ERLKTYAHLFDDKVMKQLKR-RRYTGWGRLSRKLINGIRDK QSGKTILDFLK -DGf---ANRNFMQLIHDDSL | 702 |
| WP_032464890 | 634 ERLKTYAHLFDDKVMKQLKR-RRYTGWGRLSRKLINGIRDK QSGKTILDFLK -DGf---ANRNFMQLIHDDSL | 702 |
| WP_033888930 | 459 ERLKTYAHLFDDKVMKQLKR-RRYTGWGRLSRKLINGIRDK QSGKTILDFLK -DGf---ANRNFMQLIHDDSL | 527 |
| WP_038431314 | 634 ERLKTYAHLFDDKVMKQLKR-RRYTGWGRLSRKLINGIRDK QSGKTILDFLK -DGf---ANRNFMQLIHDDSL | 702 |
| WP_038432938 | 634 ERLKTYAHLFDDKVMKQLKR-RRYTGWGRLSRKLINGIRDK QSGKTILDFLK -DGf---ANRNFMQLIHDDSL | 702 |
| WP_038434062 | 545 ERLKTYAHLFDDKVMKQLKR-RRYTGWGRLSRKLINGIRDK QSGKTILDFLK -DGf---ANRNFMQLIHDDSL | 613 |
| BAQ51233 | | |
| KGE60162 | 634 ERLKTYAHLFDDKVMKQLKR-RRYTGWGRLSRKLINGIRDK QSGKTILDFLK -DGf---ANRNFMQLIHDDSL | 702 |
| KGE60856 | 635 ERLQKYSDIFTKAQLKKLER-RHYTGWGRLSYKLINGIRNK ENKKTILDYLI DDG---YANRNFMQLINDDAL | 703 |
| WP_002989955 | 638 QRLQKYSDIFTADQLKKLER-RHYTGWGRLSYKLINGIRNK ENQKTILDYLI DDG---SANRNFMQLINDDTL | 706 |
| WP_003030002 | 633 KRLDIYKDLFFTESQLKKLYR-RHYTGWGKLSAKLINGIRDK ESQKTILDYLI DDG---ANRNFMQLIKDAGL | 701 |
| WP_003065552 | 636 KRLENYKDLFTESQLKKLYR-RHYTGWGRLSAKLINGIRDK ESQKTILDYLI DDG---RSNRNFMQLINDDGL | 704 |
| WP_001040076 | 636 KRLENYKDLFTESQLKKLYR-RHYTGWGRLSAKLINGIRDK ESQKTILDYLI DDG---RSNRNFMQLINDDGL | 704 |
| WP_001040078 | 636 KRLENYKDLFTESQLKKLYR-RHYTGWGRLSAKLINGIRDK ESQKTILDYLI DDG---RSNRNFMQLINDDGL | 704 |
| WP_001040080 | 636 KRLENYKDLFTESQLKKLYR-RHYTGWGRLSAKLINGIRDK ESQKTILDYLI DDG---RSNRNFMQLINDDGL | 704 |
| WP_001040081 | 636 KRLENYKDLFTESQLKKLYR-RHYTGWGRLSAKLINGIRDK ESQKTILDYLI DDG---RSNRNFMQLINDDGL | 704 |
| WP_001040083 | 636 KRLENYKDLFTESQLKKLYR-RHYTGWGRLSAKLINGIRDK ESQKTILDYLI DDG---RSNRNFMQLINDDGL | 704 |
| WP_001040085 | 636 KRLENYKDLFTESQLKKLYR-RHYTGWGRLSAKLINGIRDK ESQKTILDYLI DDG---RSNRNFMQLINDDGL | 704 |
| WP_001040087 | 636 KRLENYKDLFTESQLKKLYR-RHYTGWGRLSAKLINGIRDK ESQKTILDYLI DDG---RSNRNFMQLINDDGL | 704 |
| WP_001040088 | 636 KRLENYKDLFTESQLKKLYR-RHYTGWGRLSAKLINGIRDK ESQKTILDYLI DDG---RSNRNFMQLINDDGL | 704 |
| WP_001040089 | 636 KRLENYKDLFTESQLKKLYR-RHYTGWGRLSAKLINGIRDK ESQKTILDYLI DDG---RSNRNFMQLINDDGL | 704 |

| | | | | |
|---|---|---|---|---|
| WP_001040090 | 636 | KRLENYKDLFTESQLKKLYR-RHYTGWGRLSAKLINGIRDK | ESQKTILDYLI | DDG---RSNRNFMQLINDDGL | 704 |
| WP_001040091 | 636 | KRLENYKDLFTESQLKKLYR-RHYTGWGRLSAKLINGIRDK | ESQKTILDYLI | DDG---RSNRNFMQLINDDGL | 704 |
| WP_001040092 | 636 | KRLENYKDLFTESQLKKLYR-RHYTGWGRLSAKLINGIRDR | ESQKTILDYLI | SDG---RANRNFMQLINDDGL | 704 |
| WP_001040094 | 633 | KRLDIYKDFFTESQLKKLYR-RHYTGWGRLSAKLINGIRNK | ENQKTILDYLI | DDG---SANRNFMQLIKDAGL | 701 |
| WP_001040095 | 633 | KRLDIYKDFFTESQLKKLYR-RHYTGWGERLSAKLINGIRNK | ENQKTILDYLI | DDG---SANRNFMQLIKDAGL | 701 |
| WP_001040096 | 633 | KRLDIYKDFFTESQLKKLYR-RHYTGWGRLSAKLINGIRNK | ENQKTILDYLI | DDG---SANRNFMQLIKDAGL | 701 |
| WP_001040097 | 633 | KRLDIYKDFFTESQLKKLYR-RHYTGWGRLSAKLINGIRNK | ESQKTILDYLI | DDG---SANRNFMQLIKDAGL | 701 |
| WP_001040098 | 633 | KRLDIYKDFFTESQLKKLYR-RHYTGWGRLSAKLINGIRNK | ENQKTILDYLI | DDG---SANRNFMQLIKDAGL | 701 |
| WP_001040099 | 633 | KRLDIYKDFFTESQLKKLYR-RHYTGWGRLSAKLINGIRNK | ENQKTILDYLI | DDG---SANRNFMQLIKDAGL | 701 |
| WP_001040100 | 636 | KRLENYKDLFTESQLKKLYR-RHYTGWGRLSAKLINGIRDK | ESQKTILDYLI | DDG---RSNRNFMQLINDDGL | 704 |
| WP_001040104 | 636 | KRLENYKDLFTESQLKKLYR-RHYTGWGRLSAKLINGIRDK | ESQKTILDYLI | DDG---RSNRNFMQLINDDGL | 704 |
| WP_001040105 | 636 | KRLENYKDLFTESQLKKLYR-RHYTGWGRLSAKLINGIRDK | ESQKTILDYLI | DDG---RANRNFMQLINDDGL | 704 |
| WP_001040106 | 636 | KRLENYKDLFTESQLKKLYR-RHYTGWGRLSAKLINGIRNK | ESQKTILDYLI | SDG---RANRNFMQLIHDDGL | 704 |
| WP_001040107 | 636 | KRLENYKDLFTESQLKKLYR-RHYTGWGRLSAKLINGIRNK | ENQKTILDYLI | DDG---RANRNFMQLIHDDGL | 704 |
| WP_001040108 | 636 | KRLENYKDLFTESQLKKLYR-RHYTGWGRLSAKLINGIRNK | ESQKTILDYLI | SDG---RANRNFMQLIHDDGL | 704 |
| WP_001040109 | 636 | KRLENYKDLFTESQLKKLYR-RHYTGWGRLSAKLINGIRNK | ENQKTILDYLI | DDG---RANRNFMQLIHDDGL | 704 |
| WP_001040110 | 636 | KRLENYKDLFTESQLKKLYR-RHYTGWGRLSAKLINGIRDK | ESQKTILDYLI | DDG---RANRNFMQLINDDGL | 704 |
| WP_015058523 | 636 | KRLENYKDLFTESQLKKLYR-RHYTGWGRLSAKLINGIRDR | ESQKTILDYLI | DDG---RSNRNFMQLINDDGL | 704 |
| WP_017643650 | 636 | KRLENYKDLFTESQLKKLYR-RHYTGWGRLSAKLINGIRDK | ENQKTILDYLI | DDG---SANRNFMQLINDDGL | 701 |
| WP_017647151 | 636 | KRLENYKDLFTESQLKKLYR-RHYTGWGRLSAKLINGIRDK | ESQKTILDYLI | DDG---RSNRNFMQLINDDGL | 704 |
| WP_017648376 | 636 | KRLENYKDLFTESQLKKLYR-RHYTGWGRLSAKLINGIRDK | ESQKTILDYLI | DDG---KSNRNFMQLINDDGL | 704 |
| WP_017649527 | 636 | KRLENYKDLFTESQLKKLYR-RHYTGWGRLSAKLINGIRDK | ESQKTILDYLI | SDG---RANRNFMQLINDDGL | 704 |
| WP_017771611 | 633 | KRLDIYKDFFTESQLKKLYR-RHYTGWGRLSAKLINGIRNK | ENQKTILDYLI | DDG---SANRNFMQLIKDAGL | 701 |
| WP_017771984 | 636 | KRLENYKDLFTESQLKKLYR-RHYTGWGRLSAKLINGIRDK | ESQKTILDYLI | SDG---RANRNFMQLINDDGL | 704 |
| CFQ25032 | 636 | KRLENYKDLFTESQLKKLYR-RHYTGWGRLSAKLINGIRDK | ESQKTILDYLI | DDG---RSNRNFMQLINDDGL | 704 |
| CFV16040 | 636 | KRLENYKDLFTESQLKKLYR-RHYTGWGRLSAKLINGIRDR | ESQKTILDYLI | DDG---RSNRNFMQLINDDGL | 704 |
| KLJ37842 | 636 | KRLENYKDLFTESQLKKLYR-RHYTGWGRLSAKLINGIRDK | ESQKTILDYLI | DDG---RSNRNFMQLINDDGL | 704 |
| KLJ72361 | 636 | KRLENYKDLFTESQLKKLYR-RHYTGWGRLSAKLINGIRDK | ESQKTILDYLI | DDG---RSNRNFMQLINDDGL | 704 |
| KLL20707 | 636 | KRLENYKDLFTESQLKKLYR-RHYTGWGRLSAKLINGIRDK | ESQKTILDYLI | DDG---RSNRNFMQLINDDGL | 718 |
| KLL42645 | 636 | KRLENYKDLFTESQLKKLYR-RHYTGWGRLSAKLINGIRDR | ESQKTILDYLI | SDG---RANRNFMQLINDDGL | 704 |
| WP_047207273 | 636 | KRLENYKDLFTESQLKKLYR-RHYTGWGRLSAKLINGIRDK | ESQKTILDYLI | DDG---RSNRNFMQLINDDGL | 704 |
| WP_047209694 | 633 | KRLDIYKDFFTESQLKKLYR-RHYTGWGRLSAKLINGIRNK | ENQKTILDYLI | DDG---SANRNFMQLIKDAGL | 701 |
| WP_050198062 | 636 | KRLENYKDLFTESQLKKLYR-RHYTGWGRLSAKLINGIRDK | ESQKTILDYLI | DDG---RSNRNFMQLINDDGL | 704 |
| WP_050201642 | 636 | KRLENYKDLFTESQLKKLYR-RHYTGWGRLSAKLINGIRDK | ESQKTILDYLI | DDG---RANRNFMQLIHDDGL | 704 |
| WP_050204027 | 636 | KRLENYKDLFTESQLKKLYR-RHYTGWGRLSAKLINGIRDK | ESQKTILDYLI | DDG---RANRNFMQLIHDDGL | 704 |
| WP_050881965 | 636 | KRLENYKDLFTESQLKKLYR-RHYTGWGRLSAKLINGIRDK | ESQKTILDYLI | DDG---RSNRNFMQLINDDGL | 704 |
| WP_050886065 | 636 | KRLENYKDLFTESQLKKLYR-RHYTGWGRLSAKLINGIRDK | ESQKTILDYLI | DDG---RSNRNFMQLINDDGL | 704 |
| AHN30376 | 636 | KRLENYKDLFTESQLKKLYR-RHYTGWGRLSAKLINGIRDK | ESQKTILDYLI | DDG---RANRNFMQLIHDDGL | 704 |
| EA078426 | 636 | KRLENYKDLFTESQLKKLYR-RHYTGWGRLSAKLINGIRDK | ESQKTILDYLI | DDG---RSNRNFMQLINDDGL | 704 |
| CCW42055 | 636 | KRLDIYKDFFTESQLKKLYR-RHYTGWGRLSYKLINGIRNK | ENQKTILDYLI | DDG---YANRNFMQLINDDAL | 703 |
| WP_030041502 | 635 | QRLQKYSDIFTKAQLKKLER-RHYTGWGRLSYKLINGIRNK | ENKKTILDYLI | DDG---YANRNFMQLINDDAL | 704 |
| WP_037593752 | 636 | QRLQKYSDIFTKAQLKKLER-RHYTGWGRLSYKLINGIRNK | ENKKTILDYLI | DDG---YANRNFMQLINDDSL | 704 |
| WP_049516684 | 636 | QRLQKYSDIFTTQQLKKLER-RHYTGWGRLSYKLINGIRNK | ENKKTILDYLI | DDG---SANRNFMQLINDDAL | 704 |
| GAD46167 | 635 | QRLQKYSDIFTKAQLKKLER-RHYTGWGRLSYKLINGIRNK | ENKKTILDYLI | DDG---SANRNFMQLINDDAL | 703 |
| WP_018363470 | 636 | QRLQKYSDIFTKQQLKKLER-RHYTGWGRLSYKLINGIRNK | ENNKTILDYLI | DDG---SNRNFMQLINDDAL | 704 |
| WP_003043819 | 644 | ERLKTYAHLFDDKVMKQLKR-RHYTGWGRLSRKMINGIRDK | QSGKTILDFLK | -DGf---YANRNFMQLIHDDSL | 712 |
| WP_006269658 | 635 | QRLQKYSDIFTKAQLKKLER-RHYTGWGRLSYKLINGIRNK | ENKKTILEYLV | DDG---YANRNFMQLINDDTL | 703 |
| WP_048800889 | 634 | ERLKKYANLFDDKVMKQLKR-RHYTGWGRLSRKLINGIRDK | QSGKTILDFLK | -DGf---YANRNFMQLINDDSL | 703 |
| WP_012767106 | 634 | ERLKKYANLFDDKVMKQLKR-RHYTGWGRLSRKLINGIRDK | QSGKTILDFLK | -DGf---ANRNFMQLINDDSL | 702 |
| WP_014612333 | 634 | ERLKTYAHLFDDKVMKQLKR-RHYTGWGRLSRKLINGIRDK | QSGKTILDFLK | -DGf---ANRNFMQLINDDSL | 702 |
| WP_015017095 | 634 | ERLKTYAHLFDDKVMKQLKR-RHYTGWGRLSRKLINGIRDK | QSGKTILDFLK | -DGf---ANRNFIQLIHDDSL | 702 |
| WP_015057649 | 634 | ERLKTYAHLFDDKVMKQLKR-RHYTGWGRLSRKLINGIRDK | QSGKTILDFLK | -DGf---ANRNFMQLINDDSL | 702 |
| WP_048327215 | 634 | ERLKTYAHLFDDKVMKQLKR-RHYTGWGRLSRKLINGIRDK | QSGKTILDFLK | -DGf---ANRNFIQLIHDDSL | 702 |

```
WP_049519324   634  ERLKTYAHLFDDKVMKQLKR-RHYTGWGRLSRKLINGIRDK QSGKTILDFLK -DGf---ANRNFIQLIHDDSL  702
WP_012515931   634  KRLDQYAHLFDKVVLNKLER-HHYTGWGRLSGKLINGIRDK QSGKTILDFLK -DGf---ANRNFMQLIHDSEL  702
WP_021320964   634  KRLDQYAHLFDKVVLNKLER-HHYTGWGRLSGKLINGIRDK QSGKTILDFLK -DGf---ANRNFMQLIHDSEL  702
WP_037581760   634  KRLDQYAHLFDKVVLNKLER-HHYTGWGRLSGKLINGIRDK QSGKTILDFLK -DGf---ANRNFMQLIHDSEL  702
WP_004232481   635  ERLQKYSDIFTSQQLKKLER-RHYTGWGRLSYKLINGIRNK ENNKTILDFLI DDG---DANRNFMQLINDDSL  703
WP_009854540   636  ERLQKYSDIFTANQLKKLER-RHYTGWGRLSYKLINGIRNK ENNKTILDYLI DDG---SANRNFMQLINDDTL  704
WP_012962174   636  QRLQKYSDIFTPQQLKKLER-RHYTGWGRLSYKLINGIRNK ENGKSILDYLI DDG---YANRNFMQLISDDTL  704
WP_039695303   638  ERLQKYSDIFTANQLKKLER-RHYTGWGRLSYKLINGIRNK ENNKTILDYLI DDG---SANRNFMQLINDDTL  706
WP_014334983   635  ERLQKYSDFFTSQQLKKLER-RHYTGWGRLSQKLINGIRNK ENNKTILDFLI DDG---HANRNFMQLINDESL  703
WP_030099269   634  RRLVKYADVFEKSVLKKLKR-RHYTGWGRLSQKLINGIKDK QTGKTILDFLK -DGv---ANRNFMQLINDSSL  702
AHY15608       634  RRLVKYADVFEKSVLKKLKR-RHYTGWGRLSQKLINGIKDK QTGKTILGFLK -DGv---ANRNFMQLINDSSL  702
AHY17476       634  RRLVKYADVFEKSVLKKLKK-RHYTGWGRLSQKLINGIKDK QTGKTILGFLK -DGv---ANRNFMQLINDSSL  702
ESR09100       ---  -------------------------------------------------- ----------- ----------------------
AGM98575       634  RRLVKYADVFEKSVLKKKLKK-RHYTGWGRLSQKLINGIKDK QTGKTILGFLK -DGy---ANRNFMQLINDSSL  702
ALF27331       635  KRLENYSDLLTKEQVKNLER-RHYTGWGRLSAELIHGIRNK ESRKTILDYLI DDG---NSNRNFMQLINDDAL  703
WP_018372492   648  KRLSELNIPFENKIIKKLAR-KCYTGWGRLSRKLIDGIRNK DDGf---SNRNLMQLINDDGL  716
WP_045618028   634  QRLAHYASIFDEKVIKALTR-RHYTGWGKLSAKLINGIYDK QSKKTILDYLI DDG---EINRNFMQLINDDGL  702
WP_045635197   633  QRLAQYDSLFDERVIKALTR-RHYTGWGKLSAKLINGICDK QTGNTILDYLI DDG---KINRNFMQLINDDGL  701
WP_002263549   635  KRLENYSDLLTKEQVKKLER-RHYTGWGRLSAELIHGIRNK ESRKTILDYLI DDG---NSNRNFMQLINDDAL  703
WP_002263887   635  KRLENYSDLLTKEQLKKLER-RHYTGWGRLSAELIHGIRNK ESRKTILDYLI DDG---NSNRNFMQLINDDAL  703
WP_002264920   636  KRLKNYSDLLTKEQLKKLER-RHYTGWGRLSAELIHGIRNK ESRKTILDYLI DDG---NSNRNFMQLINDDAL  704
WP_002269043   635  KRLENYSDLLTKEQLKKLER-RHYTGWGRLSAELIHGIRNK ESRKTILDYLI DDG---NSNRNFMQLINDDAL  703
WP_002269448   635  KRLENYSDLLTKEQVKKLER-KCYTGWGRLSAELIHGIRNK ESRKTILDYLI DDG---NSNRNFMQLINDDAL  703
WP_002271977   635  KRLENYSDLLTKEQVKKLER-RHYTGWGRLSAELIDGIRNK ETNRTILGHLI DDG---SNRNLMQLINDDGL  703
WP_002272766   635  KRLENYSDLLTKEQVKKLER-RHYTGWGRLSAELIHGIRNK ESRKTILDYLI DDG---NSNRNFMQLINDDAL  703
WP_002273241   635  KRLENYSDLLTKEQVKKLER-RHYTGWGRLSAELIHGIRNK ESRKTILDYLI DDG---NSNRNFMQLINDDAL  703
WP_002275430   635  KRLENYSDLLTKEQVKKLER-RHYTGWGRLSAELIHGIRNK ESRKTILDYLI DDG---NSNRNFMQLINDDAL  703
WP_002276448   635  KRLENYSDLLTKEQVKKLER-RHYTGWGRLSAELIHGIRNK ESRKTILDYLI DDG---NSNRNFMQLINDDAL  703
WP_002277050   636  QRLAKYADVFDKKVIDQLAR-RHYTGWGRLSAKLNGIRDK QSCKTMDYLI DDA---QSNRNLMQLITDNL  704
WP_002277364   635  KRLENYSDLLTKEQVKKLER-RHYTGWGRLSAELIHGIRNK ESRKTILDYLI DDG---NSNRNFMQLINDDAL  703
WP_002279025   635  KRLENYSDLLTKEQVKKLER-RHYTGWGRLSAELIHGIRNK ESRKTILDYLI DDG---NSNRNFMQLINDDAL  703
WP_002279859   635  KRLENYSDLLTKEQVKKLER-RHYTGWGRLSAELIHGIRNK ESRKTILDYLI DDG---NSNRNFMQLINDDAL  703
WP_002280230   635  KRLENYSDLLTKEQVKKLER-RHYTGWGRLSAELIHGIRNK ESRKTILDYLI DDG---NSNRNFMQLINDDAL  703
WP_002281696   635  KRLENYSDLLTKEQVKKLER-RHYTGWGRLSAELIHGIRNK ESRKTILDYLI DDG---NSNRNFMQLINDDAL  703
WP_002282247   636  QRLAKYADVFDKKVIDQLAR-RHYTGWGRLSAKLLNGIRNK QSCKTMDYLI DDA---QSNRNLMQLITDDNL  704
WP_002282906   635  KRLENYSDLLTKEQVKKLER-RHYTGWGRLSAELIHGIRNK ESRKTILDYLI DDG---NSNRNFMQLINDDAL  703
WP_002283846   635  KRLENYSDLLTKEQVKKLER-RHYTGWGRLSAELIHGIRNK ESRKTILDYLI DDG---NSNRNFMQLINDDAL  703
WP_002287255   635  KRLKNYSDLLTKEQLKKLER-RHYTGWGRLSAELIHGIRNK ESRKTILDYLI DDG---NSNRNFMQLINDDAL  703
WP_002288990   635  KRLENYSDLLTKEQLKKLER-RHYTGWGRLSAELIHGIRNK ESRKTILDYLI DDG---NSNRNFMQLINDDAL  703
WP_002289641   635  KRLKNYSDLLTKEQLKKLER-RHYTGWGRLSAELIHGIRNK ESRKTILDYLI DDG---NSNRNFMQLINDDAL  703
WP_002290427   635  KRLENYSDLLTKEQLKKLER-RHYTGWGRLSAELIHGIRNK ESRKTILDYLI DDG---NSNRNFMQLINDDAL  703
WP_002295753   635  KRLENYSDLLTKEQVKKLER-RHYTGWGRLSAELIHGIRNK ESRKTILDYLI DDG---NSNRNFMQLINDDAL  703
WP_002296423   636  QRLQKYSDIFTKAQLKKLER-RHYTGWGRLSYKLINGIRDK QSNKTILDYLI DDG---NSNRNFMQLINDDAL  704
WP_002304487   645  KRLENYSDLLTKEQLKKLER-RHYTGWGRLSAELIHGIRNK ESRKTILGYLI DDG---YSNRNFMQLINDDAL  713
WP_002305844   635  KRLENYSDLLTKEQVKKLER-RHYTGWGRLSAELIHGIRNK ESRKTILDYLI DDG---NSNRNFMQLINDDAL  703
WP_002307203   635  KRLENYSDLLTKEQVKKLER-RHYTGWGRLSAELIHGIRNK ESRKTILDYLI DDG---NSNRNFMQLINDDAL  703
WP_002310390   635  KRLKNYSDLLTKEQVKKLER-RHYTGWGRLSAELIHGIRNK ESRKTILDYLI DDG---NSNRNFMQLINDDAL  703
WP_002352408   635  KRLENYSDLLTKEQVKKLER-RHYTGWGRLSAELIHGIRNK ESRKTILDYLI DDG---NSNRNFMQLINDDAL  703
WP_012977688   635  KRLENYSDLLTKEQVKKLER-RHYTGWGRLSAELIHGIRNK ESRKTILDYLI DDG---NSNRNFMQLINDDAL  703
WP_014677909   635  KRLENYSDLLTKEQLKKLER-RHYTGWGRLSAELIHGIRNK ESRKTILDYLI DDG---NSNRNFMQLINDDAL  703
WP_019312892   635  KRLENYSDLLTKEQLKKLER-RHYTGWGRLSAELIHGIRNK ESRKTILDYLI DDG---NSNRNFMQLINDDAL  703
WP_019313659   635  KRLENYSDLLTKEQVKKLER-RHYTGWGRLSAELIHGIRNK ESRKTILDYLI DDG---NSNRNFMQLINDDAL  703
WP_019314093   635  KRLENYSDLLTKEQVKKLER-RHYTGWGRLSAELIHGIRNK ESRKTILDYLI DDG---NSNRNFMQLINDDAL  703
```

-continued

```
WP_019315370  635  KRLENYSDLLTKEQVKKLER-RHYTGWGRLSAELIHGIRNK  ESRKTLLDYLI  DDG---NSNRNFMQLINDDAL  703
WP_019803776  635  KRLENYSDLLTKEQVKKLER-RHYTGWGRLSAELIHGIRNK  ESRKTILDYLI  DDG---NSNRNFMQLINDDAL  703
WP_019805234  635  KRLKNYSDLLTKEQLKKLER-RHYTGWGRLSAELIHGIRNK  ESRKTILDYLI  DDG---NSNRNFMQLINDDAL  703
WP_024783594  635  KRLENYSDLLTKEQVKKLER-RHYTGWGRLSAELIHGIRNK  ESRKTILDYLI  DDG---NSNRNFMQLINDDAL  703
WP_024784288  636  QRLAKYADVFDKKVIDQLAR-RHYTGWGRLSAKLLNGIRDK  QSCKTIMDYLI  DDA---QSNRNLMQLITDDNL  704
WP_024784666  635  KRLENYSDLLTKEQVKKLER-RHYTGWGRLSAELIHGIRNK  ESRKTILDYLI  DDG---NSNRNFMQLINDDAL  703
WP_024784894  635  KRLENYSDLLTKEQVKKLER-RHYTGWGRLSAELIHGIRNK  ESRKTILDYLI  DDG---NSNRNFMQLINDDAL  703
WP_024786433  636  QRLAKYADVFDKKVIDQLAR-RHYTGWGRLSAKLLNGIRDK  QSCKTIMDYLI  DDA---QSNRNLMQLITDDNL  704
WP_049473442  635  KRLENYSDLLTKEQVKKLER-RHYTGWGRLSAELIHGIRNK  ESRKTILDYLI  DDG---NSNRNFMQLINDDAL  703
WP_049474547  635  KRLENYSDLLTKEQVKKLER-RHYTGWGRLSAELIHGIRNK  ESRKTILDYLI  DDG---NSNRNFMQLINDDAL  703
EMC03581      628  KRLENYSDLLTKEQVKKLER-RHYTGWGRLSAELIHGIRNK  ESRKTILDYLI  DDG---NSNRNFMQLINDDAL  696
WP_000428612  636  QRLAQYDSLFDEKVIKALTR-RHYTGWGKLSSKLINGIRDK  QTGNTILDYLM  DDG---YNNRNFMQLINDDEL  704
WP_000428613  634  QRLAQYDTLFDEKVIKALIR-RHYTGWGKLSAKLIDGICDK  QTGNTILDYLI  DDG---KNNRNFMQLINDDGL  702
WP_049523028  633  QRLNQYDSIFDEKVIKALTR-RHYTGWGKLSAKLINGIRDK  KTSKTILDYLI  DDG---YSNRNFMQLINDDGL  701
WP_003107102  636  KRLSKYESIFDPSILKKLKK-RHYTGWGRLSQKLINGIRDK  HTGKTILDFLI  -DGq---ANRNFMQLINDPSL  704
WP_054279288  603  NRLAVYEDLFDQNVLKQLKQ-RHYTGWGKLSKQLINGMRDK  WTGKTILDFLK  -DGf---INRNRMQLINDDNL  671
WP_049531101  636  QRLAQYASIFDEKVIKTLTR-RHYTGWGKLSAKLINCIRDR  KTGKTILDYLI  DDG---YNNRNFMQLINDDGL  704
WP_049538452  634  QRLAQYDSIFDEKVIKALTR-RHYTGWGKLSAKLINGIRDK  QTGKTILDYLI  DDG---YSNRNFMQLINDDGL  702
WP_049549711  634  QRLAQYDSLFDKKVIKALTR-RHYTGWGKLSAKLINGILDK  QTGNTILDYLI  DDG---EINRNFMQLINDDGL  702
WP_007896501  637  KRLAKYANLFEKSVLKKLRK-RHYRGWGRLSRQLIDGMKDK  ASGKTILDFLK  -DDf---ANRNFIQLINDSSL  705
EFR44625      589  KRLAKYANLFEKSVLKKLRK-RHYRGWGRLSRQLIDGMKDK  ASGKTILDFLK  -DDf---ANRNFIQLINDSSL  657
WP_002897477  633  QRLAQYDTLFDEKVIKALTR-RHYTGWGKLSAKLINGIRDK  QSGKTILDYLI  DDD---KINRNFMQLINDDGL  701
WP_002906454  633  QRLAQYDTLFDEKVIKALTR-RHYTGWGKLSAKLINGIRDK  QTGKTILEYLI  DDG---DCNRNFMQLINDDGL  701
WP_009729476  634  QRLAQYDSLFDEKVIKALTR-RHYTGWGKLSAKLINGISDK  QTGKTILDFLK  -DGf---ANRNFMQLINDDSL  702
CQR24647      637  QRLLKYEDIFSKKVIANLTR-RHYTGWGKLSAKLINGIKDK  HSRKTILDYLI  DDG---HSNRNFMQLINDDNL  705
WP_000066813  636  QRLAQYDSLFDEKVIKALTR-RHYTGWGKLSAKLINGIRDK  KSGKTILDYLI  DDG---EINRNFMQLINDHDGL  704
WP_009754323  634  QRLAQYDSIFDEKVIKALTR-RHYTGWGKLSAKLINGICDK  KTGKTILGYLI  DDG---YNNRNFMQLINDDGL  702
WP_044674937  633  KRLEKYKDILTEEQRKKLER-RHYTGWGRLSAKLINGILDK  VTRKTILGYLI  DDG---TSNRNFMQLINDDTL  701
WP_044676715  635  KRLEKYKDVLTEEQRKKLER-RHYTGWGRLSAKLINGIRDK  VTRKTILDYLI  DDG---TSNRNFMQLINDDTL  703
WP_044680361  635  KRLEKYKDVLTEEQRKKLER-CHYTGWGRLSYKLINGIRNK  ENKKTILGYLI  DDG---YANRNFMQLINDDTL  703
WP_044681799  633  QRLQKYSDIFTKAQLKKLER-RHYTGWGRLSAKLINGILDK  ENKKTILGYLI  DDG---YANRNFMQLINDDTL  701
WP_029090905  613  RKLSEYPQLTEQQQVQLAQV--RFRGWGRLSQRLINRIKTP  EDHKLSINEIL  ------QTNENFMQIIRNKDY  682
WP_006506696  638  RRLKKKYALPDDKVKQILKL--KYKDWSRLSKKLLDGIVAD  SV--TVLDVLE  ------SRLNLMEIINDKDL  705
AIT42264      634  ERLKTYAHLFDDKVMKQLKR-RRYTGWGKLSRKLINGIRDE  QSGKTILDFLK  -DGf---ANRNFMQLIHDDSL  702
WP_034440723  638  RQLMKFKDKLSEKAINQLSK-KHYTGWGQLSERKLINGIRDE  QSNKTILDYLI  DNGcpkNMNRNFMQLINDDTL  710
AKQ21048      634  ERLKTYAHLFDDKVMKQLKR-RRYTGWGRLSRKLINGIRDK  QSGKTILDFLK  -DGf---ANRNFMQLIHDDSL  702
WP_004636532  644  KQLQTYSDTLSPEILKKLER-KHYTGWGRFSKKLLINGLRDE  GSNKTILDYLK  DEGssgPTNNRNFMQLIRDNTL  706
WP_002364836  642  TQLSTFKGQFSAEVLKKLER-KHYTGWGRLSKKLINGIYDK  ESGKTILGYLI  DDGvskHYNRNFMQLINDSQL  714
WP_016631044  593  TQLSTFKGQFSAEVLKKLER-KHYTGWGRLSKKLINGIYDK  ESGKTILGYLI  DDGvskHYNRNFMQLINDSQL  665
EMS75795      382  TQLKKYQSVLGDGFEKKLVK-KHYTGWGRLSERLINGIYDK  KTNKTILDYLI  DDGfpyNRNRNFMQLINDSQL  454
WP_002373311  642  TQLSTFKGQFSAEVLKKLER-KHYTGWGRLSKKLINGIYDK  ESGKTILGYLI  DDGvskHYNRNFMQLINDSQL  714
WP_002378009  642  TQLSTFKGQFSAEVLKKLER-KHYTGWGRLSKKLINGIYDK  ESGKTILDYLI  DDGvskHYNRNFMQLINDSQL  714
WP_002407324  642  TQLSTFKGQFSAEVLKKLER-KHYTGWGRLSKKLINGIYDK  ESGKTILDYLV  DDGvskHYNRNFMQLINDSQL  714
WP_002413717  642  TQLSTFKGQFSAEVLKKLER-KHYTGWGRLSKKLINGIYDK  ESGKTILDYLV  DDGvskHYNRNFMQLIHDDSL  714
WP_010775580  644  TQLSTFKGQFSEEVLKKLER-KHYTGWGRLSKKLINGIYDK  ESGKTILDYLV  DDGvskHYNRNFMQLINDSQL  716
WP_010818269  642  TQLSTFKGQFSAEVLKKLER-KHYTGWGRLSKKLINGIYDK  ESGKTILGYLI  DDGvskHYNRNFMQLINDSQL  714
WP_010824395  642  TQLSTFKGQFSAEVLKKLER-KHYTGWGRLSKKLINGIYDK  ESGKTILDYLI  DDGvskHYNRNFMQLINDSQL  714
WP_016622645  642  TQLSTFKGQFSAEVLKKLER-KHYTGWGRLSKKLINGIYDK  ESGKTILDYLI  DDGvskHYNRNFMQLINDSQL  714
WP_033624816  642  TQLSTFKGQFSAEVLKKLER-KHYTGWGRLSKKLINGIYDK  ESGKTILDYLI  DDGvskHYNRNFMQLINDSQL  714
WP_033625576  642  TQLSTFKGQFSAEVLKKLER-KHYTGWGRLSKKLINGIYDK  ESGKTILDYLI  DDGvskHYNRNFMQLINDSQL  714
WP_033789179  642  TQLSTFKGQFSEEVLKKLER-KHYTGWGRLSKELIQGIRDK  QSNKTILDYLI  DDGvskHYNRNFMQLINDSQL  714
WP_002310644  642  TRLSHHEATLGKHIIKKLTK-KHYTGWGRLSKELIQGIRDK  QSNKTILDYLI  DDDfphHRNRNFMQLINDDSL  714
```

```
WP_002312694   643  TRLSHHEATLGKHIIKKLTK-KHYTGWGRLSKELIQGIRDK QSNKTILDYLI DDDfphHRNRNFMQLINDDSL  715
WP_002314015   643  TRLSHHEATLGKHIIKKLTK-KHYTGWGRLSKELIQGIRDK QSNKTILDYLI DDDfphHRNRNFMQLINDDSL  715
WP_002320716   643  TRLSHHEATLGKHIIKKLTK-KHYTGWGRLSKELIQGIRDK QSNKTILDYLI DDDfphHRNRNFMQLINDDSL  715
WP_002330729   642  TRLSHHEATLGKHIIKKLTK-KHYTGWGRLSKELIQGIRDK QSNKTILDYLI DDDfphHRNRNFMQLINDDSL  714
WP_002335161   643  TRLSHHEATLGKHIIKKLTK-KHYTGWGRLSKELIQGIRDK QSNKTILDYLI DDDfphHRNRNFMQLINDDSL  715
WP_002345439   643  TRLSHHEATLGKHIIKKLTK-KHYTGWGRLSKELIQGIRDK QSNKTILDYLI DDDfphHRNRNCMQLINDDSL  715
WP_034867970   638  HQLSKYQEVFGEKLLKEFAR-KHYTGWGRFSAKLIHGIRDR KTNKTILDYLI DDDvpaNRNRNLMQLINDEHL  710
WP_047937432   643  TRLSHHEATLGKHIIKKLTK-KHYTGWGRLSKELIQGIRDK QSNKTILDYLI DDDfphHRNRNFMQLINDDSL  715
WP_010720994   638  HQLSKYQEVFGEKLLKEFAR-KHYTGWGRFSAKLIHGIRDR KTNKTILDYLI DDDvpaNRNRNLMQLINDEHL  710
WP_014073004   638  HQLSKYQEVFGEKLLKEFAR-KHYTGWGRFSAKLIHGIRDR KTNKTILDYLI DDDvpaNRNRNLMQLINDEHL  710
WP_034700478   638  HQLSKYQEVFGEKLLKEFAR-KHYTGWGRFSAKLIHGIRDR KTNKTILDYLI DDDvpaNRNRNLMQLINDEHL  710
WP_007209003   635  NQLEQLPLNLSTKTIKALsR-RKYTGWGRFSARLIDGIHDK NSGKTILDYLI DESdsyIVNRNRMQLINDDTY  707
WP_023519017   632  EQLKPYETVLGLPAIKKLAK-KHYTGWGRLSEKMIQGMREK QSRKTILDYLI DDDfpcNRNRNFMQLINDDHL  704
WP_010770040   635  EQLKKYTYLFDEBVLKKLER-RHYTGWGRLSAKLLGIKEK RTHKTILDYLI DDGgkqPINRNLMQLINDSDL  707
WP_048604708   631  EQLSKFSDRLSEKTIKDLER-RHYTGWGRLSAKLINGIHDK QSHKTILDYLI DDApkkNINRNRNFMQLINDNRL  703
WP_010750235   637  TQLKKYQRILGEEIFKKLVK-KCYTGWGRLSRKLINGIRDQ KTNKTILDYLI DDDfpyNRNRNFMQLINDDNL  709
AII16583       673  ERLKTYAHLFDDKVMKQLKR-RRYTGWGRLSRKLINGIRDK QSGKTILDFLK  -DGf---ANRNFMQLIHDDSL  741
WP_029073316   648  RRLKKEYDLDEEKIKKILKL-KYSGWGSRLSKKLLSGIKTK RTPETVLEVME  ------TMNNLMQVINDEKL  717
WP_031589969   648  RRLKKEYDLDEEKIKKILKL-KYSGWGSRLSKKLLSGIKTK RTPETVLEVME  ------TMNNLMQVINDEHL  717
KDA45870       631  RRLENYRDFLGEDILRKLSR-KKYTGWGRLSARLIDGIHDK KTHKTILDCLM  EDYs----QNFMQLINDDTY  698
WP_039099354   651  AKLNEIDWLTDQQRVQLAAK--RYRGWGRLSAKLLTQIVN- ANGQRIMDLLW  -------------TTDNFMRIVHSE-  712
AKP02966       633  EKLHSSNYSYTSDQIKKISN-MEYKGWGRLSKKILTCITTE TNTPKSLQLSN  -DLm-wTTNNNFISIISNDKY  706
WP_010991369   638  EQLQQFSDVLDGVVLKKLER-RHYTGWGRLSAKLMGIRDK QSHLTILDYLM  DDG----LNRNLMQLINDSNL  706
WP_033838504   638  EQLQQFSDVLDGVVLKKLER-RHYTGWGRLSAKLMGIRDK QSHLTILDYLM  DDG----LNRNLMQLINDSNL  706
EHN60060       641  EQLQQFSDVLDGVVLKKLER-RHYTGWGRLSAKLMGIRDK QSHLTILDYLM  DDG----LNRNLMQLINDSNL  709
EFR89594       407  EQLQSFSDVLDGVVLKKLER-RHYTGWGRLSAKLTGIRDK QSHLTILDYLM  DDG----LNRNLMQLINDSNL  475
EFR95520       257  EQLQSFSDVLDGTILKKLER-RHYTGWGRLSAKLLTGIRDK HSHLTILDYLM  DDG----LNRNLMQLINDSNL  325
WP_003723650   638  EQLQQFSDVLDGGVVLKKLER-RHYTGWGRLSAKLVGIRDK QSHLTILDYLM  DDG----LNRNLMQLINDSNL  706
WP_003727705   638  EQLEQFSDVLDGVVLKKLER-RHYTGWGRLSAKLVGIRDK QSHLTILDYLM  DDG----LNRNLMQLINDSNL  706
WP_003730785   638  EQLEQFSDVLDGVVLKKLER-RHYTGWGRLSAKLVGIRDK QSHLTILDYLM  DDG----LNRNLMQLINDSNL  706
WP_003733029   638  EQLQQFSDVLDGVVLKKLER-RHYTGWGRLSAKLVGIRDK QSHLTILDYLM  DDG----LNRNLMQLINDSNL  706
WP_003739838   638  EQLQQFSDVLDGAVLKKLER-RHYTGWGRLSAKLVGIRDK QSHLTILDYLM  DDG----LNRNLMQLINDSNL  706
WP_014601172   638  EQLQQFSDVLDGGVLKKLER-RHYTGWGRLSAKLVGIREK QSHLTILDYLM  DDG----LNRNLMQLINDSNL  706
WP_023548323   638  EQLQQFSDVLDGTVLKKLER-RHYTGWGRLSAKLVGIRDK QSHLTILDYLM  DDG----LNRNLMQLINDSNL  706
WP_031665337   638  EQLQQFSDVLDGVVLKKLER-RHYTGWGRLSAKLVGIRDK QSHLTILEYLM  DDG----LNRNLMQLINDSNL  706
WP_031669209   638  EQLQQFSDVLDGVVLKKLER-RHYTGWGRLSAKLVGIRDK QSHLTILDYLM  DDG----LNRNLMQLINDSNL  706
WP_033920898   638  EQLQQFSDVLDGVVLKKLER-RHYTGWGRLSAKLVGIRDK QSHLTILDYLM  DDG----LNRNLMQLINDSNL  706
AKI42028       641  EQLQQFSDVLDGVVLKKLER-RHYTGWGRLSAKLVGIREK QSHLTILDYLM  DDG----LNRNLMQLINDSNL  709
AKI50529       641  EQLQQFSDVLDGVVLKKLER-RHYTGWGRLSAKLVGIREK QSHLTILDYLM  DDG----LNRNLMQLINDSNL  709
EFR83390        86  EQLQQFSDVLDGVVLKKLER-RHYTGWGRLSAKLVGIRDK QSHLTILEYLM  DDG----LNRNLMQLINDSNL  154
WP_046323366   638  ERLQEFSNVLDEAVLKKLER-RHYTGWGRLSRKLINGIRDK ESHLTILDYLM  DDK----HNRNLMQLINDSNL  706
AKE81011       650  ERLKTYAHLFDDKVMKQLKR-RRYTGWGRLSRKLINGIRDK QSGKTILDFLK  -DGf---ANRNFMQLIHDDSL  718
CU082355       642  RRLKKKYALPDDKIKQIIKL--KYKDWSRLSKKLLDGIVAD SV--TVLDVLE  ------SRLNLMEIINDKEL  709
WP_033162887   645  RRLKKVYQLDDLLVDKIIKL--NYTGWGRLSEKLLTGWTAD KA--TVLFVLE  ------SNKNLMEIINDEKL  712
AGZ01981       667  ERLKTYAHLFDDKVMKQLKR-RRYTGWGRLSRKLINGIRDK QSGKTILDFLK  -DGf---ANRNFMQLIHDDSL  735
AKA60242       634  ERLKTYAHLFDDKVMKQLKR-RRYTGWGRLSRKLINGIRDK QSGKTILDFLK  -DGf---ANRNFMQLIHDDSL  702
AKS40380       634  ERLKTYAHLFDDKVMKQLKR-RRYTGWGRLSRKLINGIRDK QSGKTILDFLK  -DGf---ANRNFMQLIHDDSL  702
4UN5_B         638  ERLKTYAHLFDDKVMKQLKR-RRYTGWGRLSRKLINGIRDK QSGKTILDFLK  -DGf---ANRNFMQLIHDDSL  706
WP_010922251   703  TFKEDIQKAQVSG-QDS-LHEHIANLAGSPAIKKGILQTVVDELVKKGLLQSVSKIVDELVKVMG-rHKPENIVIEMA|RENQ TTQKGQKNS  777
WP_039695303   707  PFKQIIQKSQVVG-DVDD-IEAVVHDLPGSPAIKKGILQSVKIVDELVKVMG-GNPDNIVIEMARENQ TTNRGRSQS  780
WP_045635197   702  SFKEIIQKAQVIG-KTDD-VKQVVQELSGSPAIKKGILQSIKIVDELVKVMG-HAPESIVIEMARENQ TTARGKKNS  775
5AXW_A         427  VPKKVDLSQQKEI--PT--TLVDDFILSPVVKRSFIQSIKVINAIIKKYG--LPNDIIIELAREKN ------S  487
```

-continued

| | | | |
|---|---|---|---|
| WP_009880683 | 387 | TFKEDIQKAQVSG-QGDS-LHEHIANLAGSPAIKKGILQTVKVVDELVKVMGrHKPENIVIEMARENQ TTQKGQKNS | 461 |
| WP_010922251 | 703 | TFKEDIQKAQVSG-QGDS-LHEHIANLAGSPAIKKGILQTVKVVDELVKVMGrHKPENIVIEMARENQ TTQKGQKNS | 777 |
| WP_011054416 | 703 | TFKEDIQKAQVSG-QGDS-LHEHIANLAGSPAIKKGILQTVKVVDELVKVMGrHKPENIVIEMARENQ TTQKGQKNS | 777 |
| WP_011284745 | 703 | TFKEDIQKAQVSG-QGDS-LHEHIANLAGSPAIKKGILQTVKVVDELVKVMGrHKPENIVIEMARENQ TTQKGQKNS | 777 |
| WP_011285506 | 703 | TFKEDIQKAQVSG-QGDS-LHEHIANLAGSPAIKKGILQTVKVVDELVKVMGrHKPENIVIEMARENQ TTQKGQKNS | 777 |
| WP_011527619 | 703 | TFKEDIQKAQVSG-QGDS-LHEHIANLAGSPAIKKGILQTVKVVDELVKVMGrHKPENIVIEMARENQ TTQKGQKNS | 777 |
| WP_012560673 | 703 | TFKEDLQKAQVSG-QGDS-LHEHIANLAGSPAIKKGILQTVKVVDELVKVMGrHKPENIVIEMARENQ TTQKGQKNS | 777 |
| WP_014407541 | 703 | TFKEDIQKAQVSG-QGHS-LHEQIANLAGSPAIKKGILQTVKVVDELVKVMG-HKPENIVIEMARENQ TTQKGQKNS | 776 |
| WP_020905136 | 703 | TFKEAIQKAQVSG-QGDS-LHEQIANLAGSPAIKKGILQTVKVVDELVKVMG-HKPENIVIEMARENQ TTQKGQKNS | 776 |
| WP_023080005 | 703 | TFKEDIQKAQVSG-QGHS-LHEQIANLAGSPAIKKGILQTVKVVDELVKVMG-HKPENIVIEMARENQ TTQKGQKNS | 776 |
| WP_023610282 | 703 | TFKEDIQKAQVSG-QGDS-LHEHIANLAGSPAIKKGILQTVKVVDELVKVMGrHKPENIVIEMARENQ TTQKGQKNS | 777 |
| WP_030125963 | 703 | TFKEDIQKAQVSG-QGDS-LHEHIANLAGSPAIKKGILQTVKVVDELVKVMGrHKPENIVIEMARENQ TTQKGQKNS | 777 |
| WP_030126706 | 703 | TFKEDIQKAQVSG-QGDS-LHEHIANLAGSPAIKKGILQTVKVVDELVKVMGrHKPENIVIEMARENQ TTQKGQKNS | 777 |
| WP_031488318 | 703 | TFKEDIQKAQVSG-QGDS-LHEHIANLAGSPAIKKGILQTVKVVDELVKVMGrHKPENIVIEMARENQ TTQKGQKNS | 777 |
| WP_032460140 | 703 | TFKEDIQKAQVSG-QGDS-LHEHIANLAGSPAIKKGILQTVKVVDELVKVMGrHKPENIVIEMARENQ TTQKGQKNS | 777 |
| WP_032461047 | 703 | TFKEDIQKAQVSG-QGDS-LHEHIANLAGSPAIKKGILQTVKVVDELVKVMGrHKPENIVIEMARENQ TTQKGQKNS | 777 |
| WP_032462016 | 703 | TFKEDIQKAQVSG-QGDS-LHEHIANLAGSPAIKKGILQTVKVVDELVKVMGrHKPENIVIEMARENQ TTQKGQKNS | 777 |
| WP_032462936 | 703 | TFKEDIQKAQVSG-QGDS-LHEHIANLAGSPAIKKGILQTVKVVDELVKVMGrHKPENIVIEMARENQ TTQKGQKNS | 777 |
| WP_032464890 | 528 | TFKEDIQKAQVSG-QGDS-LHEHIANLAGSPAIKKGILQTVKVVDELVKVMGrHKPENIVIEMARENQ TTQKGQKNS | 602 |
| WP_033888930 | 703 | TFKEDIQKAQVSG-QGDS-LHEHIANLAGSPAIKKGILQTVKVVDELVKVMGrHKPENIVIEMARENQ TTQKGQKNS | 777 |
| WP_038431314 | 703 | TFKEAIQKAQVSG-QGHS-LHEQIANLAGSPAIKKGILQTVKIVDELVKVMG-HKPENIVIEMARENQ TTQKGQKNS | 776 |
| WP_038432938 | 703 | TFKEDIQKAQVSG-QGDS-LHEHIANLAGSPAIKKGILQTVKVVDELVKVMGrHKPENIVIEMARENQ TTQKGQKNS | 777 |
| WP_038434062 | 703 | TFKEDIQKAQVSG-QGDS-LHEHIANLAGSPAIKKGILQTVKVVDELVKVMGrHKPENIVIEMARENQ TTQKGQKNS | 777 |
| BAQ51233 | 614 | TFKEDIQKAQVSG-QGDS-LHEHIANLAGSPAIKKGILQTVKVVDELVKVMGrHKPENIVIEMARENQ TTQKGQKNS | 688 |
| KGE60162 | | ------------------------------------------------------------------- --------- | |
| KGE60856 | | ------------------------------------------------------------------- --------- | |
| WP_002989955 | 703 | TFKPIIDKAQVSG-QGDS-LHEHIANLAGSPAIKKGILQSVKIVDELVKVMG-HKPENIVIEMARENQ TTQKGQKNS | 777 |
| WP_003030002 | 704 | SFKEEIARAQIIG-DVDD-IANVHDLPGSPAIKKGILQSVKIVDELVKVMG-HNPANIIIEMARENQ MTDKGRRNS | 777 |
| WP_003065552 | 707 | PFKQIIQKSQVVG-DVDD-IEAVVHDLPGSPAIKKGILQSVKIVDELVKVMG-DNPDNIVIEMARENQ TTNRGRSQS | 780 |
| WP_001040076 | 702 | SFKPIIDKARTGS-HSDN-LKEVIGELAGSPAIKKGILQSLKIVDELVKVMG-YEPEQIVVEMARENQ TTAKGLSRS | 775 |
| WP_001040078 | 705 | SFKPIIDKAQAGS-HSDN-LKEVVGELAGSPAIKKGILQSLKIVDELVKVMG-YEPEQIVVEMARENQ TTNQGRRNS | 778 |
| WP_001040080 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040081 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040083 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040085 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040087 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040088 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040089 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040090 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040091 | 705 | SFKSIISKAQSGS-HSDN-LKEVVGELAGSPAIKKGILQSLKIVDELVKVMG-YEPEQIVVEMARENQ TTNQGRRNS | 778 |
| WP_001040092 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040094 | 702 | SFKPIIDKARTGS-HSDN-LKEVVGELAGSPAIKKGILQSLKIVDELVKVMG-YEPEQIVVEMARENQ TTAKGLSRS | 775 |
| WP_001040095 | 702 | SFKPIIDKARTGS-HSDN-LKEVVGELAGSPAIKKGILQSLKIVDELVKVMG-YEPEQIVVEMARENQ TTAKGLSRS | 775 |
| WP_001040096 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040097 | 702 | SFKPIIDKARTGS-HLDN-LKEVVGELAGSPAIKKGILQSLKIVDELVKVMG-YEPEQIVVEMARENQ TTAKGLSRL | 775 |
| WP_001040098 | 702 | SFKPIIDKARTGS-HLDN-LKEVVGELAGSPAIKKGILQSLKIVDELVKVMG-YEPEQIVVEMARENQ TTAKGLSRS | 775 |
| WP_001040099 | 702 | SFKPIIDKARTGS-HLDN-LKEVVGELAGSPAIKKGILQSLKIVDELVKVMG-YEPEQIVVEMARENQ TTAKGLSRS | 775 |
| WP_001040100 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040104 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040105 | 702 | SFKPIIDKARTGS-HSDN-LKEVVGELAGSPAIKKGILQSLKIVDELVKVMG-YEPEQIVVEMARENQ TTAKGLSRS | 775 |
| WP_001040106 | 705 | SFKPIIDKAQAGS-HSDN-LKEVVGELAGSPAIKKGILQSLKIVDELVKVMG-YEPEQVVVEMARENQ TTNQGRRNT | 778 |
| WP_001040107 | 705 | SFKPIIDKAQAGS-HSDN-LKEVVGELAGSPAIKKGILQSLKIVDELVKVMG-YEPEQVVVEMARENQ TTNQGRRNT | 778 |
| WP_001040108 | 705 | SFKPIIDKAQAGS-HSDN-LKEVVGELAGSPAIKKGILQSLKIVDELVKVMG-YEPEQVVVEMARENQ TTNQGRRNT | 778 |

```
-continued

WP_001040109  705 SFKPIIDKAQAGS-HSDN-LKEVVGELAGSPAIKKGILQSLKIVDELVKVMG-YEPEQVVVEMAREMQ TTNQGRRNT 778
WP_001040110  705 SFKPIIDKAQAGS-HSDN-LKEVVGELAGSPAIKKGILQSLKIVDELVKVMG-YEPEQVVVEMAREMQ TTNQGRRNT 778
WP_015058523  705 SFKSIISKAQSGS-HSDN-LKEVVGELAGSPAIKKGILQSLKIVDELVKVMG-YEPEQIVVEMAREMQ TTNQGRRNS 778
WP_017643650  702 SFKPIIDKARTGS-HSDN-LKEVVGELAGSPAIKKGILQSLKIVDELVKVMG-YEPEQIVVEMAREMQ TTAKGLSRL 775
WP_017647151  705 SFKSIISKAQAGS-HSDN-LKEVVGELAGSPAIKKGILQSLKIVDELVKVMG-YEPEQIVVEMAREMQ TTNQGRRNS 778
WP_017648376  705 SFKSIISKAQAGS-HSDN-LKEVVGELAGSPAIKKGILQSLKIVDELVKVMG-YEPEQIVVEMAREMQ TTNQGRRNS 778
WP_017649527  705 SFKSIISKAQAGS-HSDN-LKEVVGELAGSPAIKKGILQSLKIVDELVKVMG-YEPEQIVVEMAREMQ TTNQGRRNS 778
WP_017771611  705 SFKPIIDKAQAGS-HSDN-LKEVVGELAGSPAIKKGILQSLKIVDELVKVMG-YEPEQVVVEMAREMQ TTNQGRRNT 778
WP_017771984  705 SFKSIISKAQAGS-HSDN-LKEVVGELAGSPAIKKGILQSLKIVDELVKVMG-YEPEQIVVEMAREMQ TTNQGRRNS 778
CFQ25032      705 SFKSIISKAQAGS-HSDN-LKEVVGELAGSPAIKKGILQSLKIVDELVKVMG-YEPEQIVVEMAREMQ TTNQGRRNS 778
CFV16040      705 SFKSIISKAQAGS-HSDN-LKEVVGELAGSPAIKKGILQSLKIVDELVKVMG-YEPEQIVVEMAREMQ TTNQGRRNS 778
KLJ37842      705 SFKSIISKAQSGS-HSDN-LKEVVGELAGSPAIKKGILQSLKIVDELVKVMG-YEPEQIVVEMAREMQ TTNQGRRNS 778
KLJ72361      719 SFKPIIDKARTGS-HSDN-LKEVVGELAGSPAIKKGILQSLKIVDELVKVMG-YEPEQIVVEMAREMQ TTAKGLSRS 792
KLL20707      702 SFKPIIDKARTGS-HSDN-LKEVVGELAGSPAIKKGILQSLKIVDELVKVMG-YEPEQIVVEMAREMQ TTAKGLSRS 775
KLL42645      705 SFKSIISKAQAGS-HSDN-LKEVVGELAGSPAIKKGILQSLKIVDELVKVMG-YEPEQIVVEMAREMQ TTNKGRRNT 778
WP_047207273  705 SFKSIISKAQAGS-HSDN-LKEVVGELAGSPAIKKGILQSLKIVDELVKVMG-YEPEQIVVEMAREMQ TTNQGRRNS 778
WP_047209694  705 SFKPIIDKAQAGS-HSDN-LKEVVGELAGSPAIKKGILQSLKIVDELVKVMG-YEPEQVVVEMAREMQ TTNQGRRNT 778
WP_050198062  705 SFKSIISKAQAGS-HSDN-LKEVVGELAGSPAIKKGILQSLKIVDELVKVMG-YEPEQIVVEMAREMQ TTNQGRRNS 778
WP_050201642  705 SFKSIISKAQAGS-HSDN-LKEVVGELAGSPAIKKGILQSLKIVDELVKVMG-YEPEQIVVEMAREMQ TTNQGRRNS 778
WP_050204027  705 SFKPIIDKAQAGS-HSDN-LKEVVGELAGSPAIKKGILQSLKIVDELVKVMG-YEPEQVVVEMAREMQ TTNQGRRNT 778
WP_050881965  705 SFKSIISKAQAGS-HSDN-LKEVVGELAGSPAIKKGILQSLKIVDELVKVMG-YEPEQIVVEMAREMQ TTNQGRRNS 778
WP_050886065  705 SFKSIISKAQAGS-HSDN-LKEVVGELAGSPAIKKGILQSLKIVDELVKVMG-YEPEQIVVEMAREMQ TTNQGRRNS 778
AHN30376      705 SFKSIISKAQSGS-HSDN-LKEVVSELAGSPAIKKGILQSLKIVDELVKVMG-YKPEQIVVEMAREMQ TTNQGRRNS 778
EA078426      705 SFKEIAKAQIIG-DVDD-IANVHDLPGSPAIKKGILQSVKIVDELVKVMG-HNPANIIIEMAREMQ TTDRGRRNS 778
CCW42055      705 SFKEIAKAQIIG-DVDD-IANVHDLPGSPAIKKGILQSVKIVDELVKVMG-HNPANIIIEMAREMQ TTDRGRRNS 778
WP_003041502  704 SFKEEIARAQIIG-DVDD-IANVHDLPGSPAIKKGILQSVKIVDELVKVMG-HNPANIIIEMAREMQ TTDKGRRNS 777
WP_037593752  705 SFKEEIARAQIIG-DVDD-IANVHDLPGSPAIKKGILQSVKIVDELVKVMG-HNPANIIIEMAREMQ TTDKGRRNS 778
WP_049516684  705 SFKEEIARAQIIG-DVDD-IANVHDLPGSPAIKKGILQSVKIVDELVKVMG-HNPANIIIEMAREMQ TTDKGRRNS 778
GAD46167      704 SFKEEIARAQIIG-DVDD-IANVHDLPGSPAIKKGILQSVKIVDELVKVMG-HNPANIIIEMAREMQ TTDKGRRNS 777
WP_018363470  705 SFKQIIQEAQVVG-DVDD-IETVHDLPGSPAIKKGILQSVKIVDELIKVMG-DNPDNIVIEMAREMQ TTNRGRSQS 778
WP_003043819  713 TFKEEIEKAQVSG-QGDS-LHEQIADLAGSPAIKKGILQTVKIVDELVKVMG-HKPENIVIEMAREMQ TTTKGLQQS 786
WP_006269658  704 SFKEEIARAQIIG-DVDD-IANVHDLPGSPAIKKGILQSVKIVDELVKVMG-HNPANIIIEMAREMQ TTDKGRRNS 777
WP_048800889  704 PFKQIIKDAQAID-DVDD-IELIVHDLPGSPAIKKGILQSIKIVDELVKVMG-YNPDNIVIEMAREMQ TTTKGRRNS 777
WP_012767106  704 TFKEAIQKAQVSG-QGHS-LHEQIANLAGSPAIKKGILQSVKIVDELVKVMG-HKPENIVIEMAREMQ TTQKGQKNS 776
WP_014612333  703 TFKEAIQKAQVSG-QGHS-LHEQIANLAGSPAIKKGILQSVKIVDELVKVMG-HKPENIVIEMAREMQ TTQKGQKNS 776
WP_015017095  703 TFKEAIQKAQVSG-QGHS-LHEQIANLAGSPAIKKGILQSVKIVDELVKVMG-HKPENIVIEMAREMQ TTQKGQKNS 776
WP_015057649  703 TFKEAIQKAQVSG-QGHS-LHEQIANLAGSPAIKKGILQSVKIVDELVKVMG-HKPENIVIEMAREMQ TTQKGQKNS 776
WP_048272215  703 TFKEAIQKAQVSG-QGHS-LHEQIANLAGSPAIKKGILQSVKIVDELVKVMG-HKPENIVIEMAREMQ TTQKGQKNS 776
WP_049151924  703 SFIDEIAKAQVIG-KTEY-SKDIVGNLAGSPAIKKGILQSTIKIVDELVKIMG-YLPQQIVIEMAREMQ TTAQGIKNA 776
WP_021320964  703 SFIDEIAKAQVIG-KTEY-SKDLVGNLASSPAIKKGILQSTIKIVDELVKIMG-YLPQQIVIEMAREMQ TTAQGIKNA 776
WP_037581760  703 SFIDEIAKAQVIG-KTEY-SKDLVGNLAGSPAIKKGISQTIKIVDELVKIMG-YLPQQIVIEMAREMQ TTAQGIKNA 776
WP_004232481  704 SFKTTIQEAQVVG-DVDD-IEAVVHDLPGSPAIKKGILQSVKIVDELVKVMG-HNPQNIVIEMAREMQ ITGYGRRNS 777
WP_009854540  705 PFKQIIQKSQVVG-DVDD-IEAVVHDLPGSPAIKKGILQSVKIVDELVKVMG-DNPDNIVIEMAREMQ TTNRGRRNS 778
WP_012962174  707 PFKQIIDAQIIG-DIDD-VTSVRELPGSPAIKKGILQSVKIVDELVKIMG-HNPDNIVIEMAREMQ TTNRGRNQS 780
WP_039695303  704 PFKQIIQKSQVVG-DVDD-IEAVVHDLPGSPAIKKGILQSVKIVDELVKVMG-GNPDNIVIEMAREMQ TTNRGRRNS 777
WP_014334983  703 SFKTIIQEAQVVG-DVDD-IEAVVHDLPGSPAIKKGILQSVKIVDELVKVMG-DNPDNIVIEMAREMQ TTGYGRNKS 777
WP_030099269  703 DFAKIKNEQEKTIKNES-LEETIANLAGSPAIKKGILQSIKIVDELVKIMG-QNPDNIVIEMAREMQ STMQGIKNS 777
AHY15608      703 DFAKIKNEQEKTIKNES-LEETIANLAGSPAIKKGILQSIKIVDELVKIMG-QNPDNIVIEMAREMQ STMQGIKNS 777
AHY17476      704 DFAKIKNEQEKTIKNES-LEETIANLAGSPAIKKGILQSIKIVDELVKIMG-QNPDNIVIEMAREMQ STMQGIKNS
ESR09100          ---------------------------------------------------------------------
AGM98575      703 DFAKIKNEQEKTIKNES-LEETIANLAGSPAIKKGILQSIKIVDEIVKIMG-QNPDNIVIEMAREMQ STMQGIKNS 777
ALF27331      704 SFKEEIAKAQVIG-ETDN-LNQVVSDIAGSPAIKKGILQSLKIVDELVKIMG-HQPENIVIEMAREMQ FTNQGRRNS 777
```

```
-continued

WP_018372492  717  DFKEIIRKAQTIE-NIDT-NQALVSSLPGSPAIKKGILQSLNIVDEIIAIMG-YAPTNIVIEMARENQ TTQKGRDNS  790
WP_045618028  703  SFKEIIQKAQVVG-KTND-VKQVQELPGSGSPAIKKGILQSIKIVDELVKIMG-HAPESIVIEMARENQ TTARGKKNS  776
WP_045635197  702  SFKEIIQKAQVIG-KTDD-VKQVQELSGSPAIKKGILQSIKIVDELVKVMG-HAPESIVIEMARENQ TTARGKKNS  775
WP_002263887  704  SFKEEIAKAQVIG-ETDN-LNQVVSDIAGSPAIKKGILQSLKIVDELVKIMG-HQPENIVVEMARENQ FTNQGRRNS  777
WP_002264920  704  SFKEEIAKAQVIG-ETDN-LNQVVSDIAGSPAIKKGILQSLKIVDELVKIMG-HQPENIVVEMARENQ FTNQGRRNS  777
WP_002269043  704  SFKEEIAKAQVIG-ETDN-LNQVVSDIAGSPAIKKGILQSLKIVDELVKIMG-HQPENIVVEMARENQ FTNQGRRNS  777
WP_002269448  704  SFKEEIAKAQVIG-ETDN-LNQVVSDIAGSPAIKKGILQSLKIVDELVKIMG-HQPENIVVEMARENQ FTNQGRRNS  777
WP_002271977  704  SFKEEIAKAQVIG-ETDN-LNQVVSDIAGSPAIKKGILQSLKIVDELVKIMG-HQPENIVVEMARENQ FTNQGRQNS  777
WP_002272766  704  SFKEEIAKAQVIG-ETDN-LNQVVSDIAGSPAIKKGILQSLKIVDELVKIMG-HQPENIVVEMARENQ FTNQGRRNS  777
WP_002273241  704  SFKEEIAKAQVIG-ETDN-LNQVVSDIAGSPAIKKGILQSLKIVDELVKIMG-HQPENIVVEMARENQ FTKQGRRNS  777
WP_002275430  704  SFKEEIAKAQVIG-ETDN-LNQVVSDIAGSPAIKKGILQSLKIVDELVKIMG-HQPENIVVEMARENQ FTNQGRRNS  777
WP_002276448  704  SFKEEIAKAQVIG-ETDN-LNQVVSDIAGSPAIKKGILQSLKIVDELVKVMG-HQPENIVVEMARENQ FTNQGRRNS  777
WP_002277050  705  TFKDDIVKAQYVD-NSDD-LHQVVQSLAGSPAIKKGILQSLKIVDELVKVMG-KEPEQIVVEMARENQ TTAKGRRNS  778
WP_002277364  704  SFKEEIAKAQVIG-ETDN-LNQVVSDIAGSPAIKKGILQSLKIVDELVKIMG-HQPENIVVEMARENQ FTNQGRRNS  777
WP_002279025  704  SFKEEIAKAQVIG-ETDN-LNQVVSDIAGSPAIKKGILQSLKIVDELVKIMG-HQPENIVVEMARENQ FTNQGRRNS  777
WP_002279859  704  SFKEEIAKAQVIG-ETDN-LNQVVSDIAGSPAIKKGILQSLKIVDELVKIMG-HQPENIVVEMARENQ FTKQGRRNS  777
WP_002280230  704  SFKEEIAKAQVIG-ETDN-LNQVVSDIAGSPAIKKGILQSLKIVDELVKIMG-HQPENIVVEMARENQ FTNQGRRNS  777
WP_002281696  704  SFKEEIAKAQVIG-ETDN-LNQVVSDIAGSPAIKKGILQSLKIVDELVKIMG-HQPENIVVEMARENQ FTNQGRRNS  777
WP_002282247  705  TFKDDIVKAQYVD-NSDD-LHQVVSLAGSPAIKKGILQSLKIVDELVKVMG-KEPEQIVVEMARENQ TTAKGRRNS  778
WP_002282906  704  SFKEEIAKAQVIG-ETDN-LNQVVSDIAGSPAIKKGILQSLKIVDELVKIMG-HQPENIVVEMARENQ FTNQGRRNS  777
WP_002283846  704  SFKEEIAKAQVIG-ETDN-LNQVVSDIAGSPAIKKGILQSLKIVDELVKIMG-HQPENIVVEMARENQ FTNQGRRNS  777
WP_002287255  704  SFKEEIAKAQVIG-ETDN-LNQVVSDIAGSPAIKKGILQSLKIVDELVKIMG-HQPENIVVEMARENQ FTNQGRRNS  777
WP_002288990  704  SFKEEIAKAQVIG-ETDN-LNQVVSDIAGSPAIKKGILQSLKIVDELVKIMG-HQPENIVVEMARENQ FTNQGRRNS  777
WP_002289641  704  SFKEEIAKAQVIG-ETDN-LNQVVSDIAGSPAIKKGILQSLKIVDELVKIMG-HQPENIVVEMARENQ FTNQGRRNS  777
WP_002290427  704  SFKEEIAKAQVIG-ETDN-LNQVVSDIAGSLAIKKGILQSLKIVDELVKIMG-HQPENIVVEMARENQ FTNQGRRNS  777
WP_002295753  704  SFKEEIAKAQVIG-ETDN-LNQVVSDIAGSPAIKKGILQSLKIVDELVKIMG-HQPENIVVEMARENQ FTNQGRRNS  777
WP_002296423  704  SFKEEIAKAQVIG-ETDN-LNQVVSDIAGSPAIKKGILQSLKIVDELVKIMG-HQPENIVVEMARENQ FTNQGRRNS  777
WP_002304487  714  SFKEEIAKAQVIG-EMDG-LNQVVSDIAGSPAIKKGILQSLKIVDELVKVMG-HNPANIVIEMARENQ TTAKGRSS  787
WP_002305844  704  SFKEEIAKAQVIG-ETDN-LNQVVSDIAGSPAIKKGILQSLKIVDELVKIMG-HQPENIVVEMARENQ FTKQGRRNS  777
WP_002307203  704  SFKEEIAKAQVIG-ETDN-LNQVVSDIAGSLAIKKGILQSLKIVDELVKIMG-HQPENIVVEMARENQ FTNQGRRNS  777
WP_002310390  704  SFKEEIAKAQVIG-ETDN-LNQVVSDIAGSPAIKKGILQSLKIVDELVKIMG-HQPENIVVEMARENQ FTNQGRRNS  777
WP_002352408  704  SFKEEIAKAQVIG-ETDN-LNQVVSDIAGSPAIKKGILQSLKIVDELVKIMG-HQPENIVVEMARENQ FTNQGQRNS  777
WP_012997688  704  SFKEEIAKAQVIG-ETDN-LNQVVSDIAGSPAIKKGILQSLKIVDELVKIMG-HQPENIVVEMARENQ FTNQGRRNS  777
WP_014677909  704  SFKEEIAKAQVIG-ETDN-LNQVVSDIAGSPAIKKGILQSLKIVDELVKIMG-HQPENIVVEMARENQ FTNQGRRNS  777
WP_019312892  704  SFKEEIAKAQVIG-ETDN-LNQVVSDIAGSPAIKKGILQSLKIVDELVKIMG-HQPENIVVEMARENQ FTNQGRRNS  777
WP_019313659  704  SFKEEIAKAQVIG-ETDN-LNQVVSDIAGSPAIKKGILQSLKIVDELVKIMG-HQPENIVVEMARENQ FTNQGRRNS  777
WP_019314093  705  TFKDDIVKAQYVD-NSDD-LHQVVQSLAGSPAIKKGILQSLKIVDELVKIMG-KEPEQIVVEMARENQ TTAKGRRNS  778
WP_019315370  704  SFKEEIAKAQVIG-ETDN-LNQVVSDIAGSPAIKKGILQSLKIVDELVKIMG-HQPENIVVEMARENQ FTNQGRRNS  777
WP_019803776  704  SFKEEIAKAQVIG-ETDN-LNQVVSDIAGSLAIKKGILQNLKIVDELVKIMG-HQPENIVVEMARENQ FTNQGRRNS  777
WP_019805234  697  SFKEEIAKAQVIG-ETDN-LNQVVSDIAGSLAIKKGILQSLKIVDELVKIMG-HQPENIVVEMARENQ FTNQGRRNS  770
WP_024783594  705  SFKEIIKKAQVIG-ETDN-LNQVVSDIAGSPAIKKGILQSIKIVDELVKVMG-HEPESIVIEMARENQ TTARGKKNS  778
WP_024784288  704  SFKEEIAKAQVIG-ETDN-LNQVVSDIAGSPAIKKGILQSLKIVDELVKIMG-HQPENIVVEMARENQ FTNQGRRNS  777
WP_024784666  704  SFKEEIAKAQVIG-ETDN-LNQVVSDIAGSPAIKKGILQSLKIVDELVKIMG-HQPENIVVEMARENQ FTNQGRRNS  777
WP_024784894  704  SFKEEIAKAQVIG-ETDN-LNQVVSDIAGSPAIKKGILQSLKIVDELVKIMG-HQPENIVVEMARENQ FTNQGRRNS  777
WP_024786433  705  TFKDDIVKAQYVD-NSDD-LHQVVQSLAGSPAIKKGILQSLKIVDELVKIMG-KEPEQIVVEMARENQ TTAKGRRNS  778
WP_049473442  704  SFKEEIAKAQVIG-ETDN-LNQVVSDIAGSPAIKKGILQSLKIVDELVKIMG-HQPENIVVEMARENQ FTNQGRRNS  777
WP_049474547  704  SFKEEIAKAQVIG-ETDN-LNQVVSDIAGSPAIKKGILQSLKIVDELVKIMG-HQPENIVVEMARENQ FTNQGRRNS  777
EMC03581      697  SFKEEIAKAQVIG-ETDN-LNQVVSDIAGSLAIKKGILQSLKIVDELVKIMG-HQPENIVVEMARENQ FTNQGRRNS  770
WP_000428612  705  SFKETIQKAQVVG-KTDD-VKQVQELPGSPAIKKGILQSIKIVDELVKVMG-HTPESIVIEMARENQ TTARGKKNS  778
WP_000428613  703  SFKEIIQKAQVVG-KTDD-VKQVQELPGSPAIKKGILQSIKIVDELVKVMG-HTPESIVIEMARENQ TTARGKKNS  776
WP_049523028  702  SFKETIQKAQVVG-ETND-VKQVQELPGSPAIKKGILQSIKIVDELVKVMG-HAPESVIEMARENQ TTNKGKSKS  775
WP_003107102  672  DFASIIKEAQEKTIKSEK-LEETIANLAGSPAIKKGILQSVKIVDELVKVMG-DEVVEVKVMG YEPSNIVIEMARENQ STQRGINNS  746
```

| ID | Start | Sequence | End |
|---|---|---|---|
| WP_054279288 | 705 | SFKEEIKAQEGG-LKDS-INDQIRDLAGSPAIKKGLLQTINIVDEIVKIMG-KAPQHIVVEMARDVQ KTDIGVKQS | 778 |
| WP_049531101 | 703 | SFKEIIQESQVVG-KPDD-VKQIVQELPGSSAIKKGILQSIKLVDELVKVMG-HDPESIVIEMARENQ TTARGKKNS | 776 |
| WP_049538452 | 703 | SFKEIIQKAQVFG-KTND-VKQVVQELPGSPAIKKGILQSIKIVEELVKVMG-HEPESIVIEMARENQ TTTRGKKNS | 776 |
| WP_049549711 | 703 | SFKKIIQKSQVVG-ETDD-VKQVVRELPGSPAIKKGILQSIKIVDELVKIMG-HAPESIVIEMARENQ TTARGKKNS | 776 |
| WP_007896501 | 706 | DFEKLIDDAQKKAiKRES-LTEAVANLAGSPAIKKGILQSLKVVDEIVKVMG-HNPDNIVIEMSRENQ TTAQGLKNA | 780 |
| EFR44625 | 658 | DFEKLIDDAQKKAiKRES-LTEAVANLAGSPAIKKGILQSLKVVDEIVKVMG-HNPDNIVIEMSRENQ TTAQGLKNA | 732 |
| WP_002897477 | 702 | SFKEIIQKAQVVG-KTDD-VKQVVQELPGSPAIKKGILQSIKIVDELVKVMG-YALESIVIEMARENQ TTARGKKNS | 775 |
| WP_002906454 | 703 | SFKEIIQKAQVVG-KTDD-VKQVVQEIPGSPAIKKGILQSIKIVDELVKVMG-HNPESIVIEMARENQ TTAKGKKNS | 775 |
| WP_009729476 | 703 | SFKEIIQKAQVVG-KTND-VKQVVQELPGSPAIKKGILQSIKIVDELVKVMG-HAPESIVIEMARENQ TTARGKKNS | 776 |
| CQR24647 | 706 | SFKDEIANSQVIG-DGDD-LHQVVQELAGSPAIKKGILQSIKIVDELVKVMG-YNPEQIVVEMARENQ TTARGRNNS | 779 |
| WP_000066813 | 705 | SFKEIIQKAQVFG-KTND-VKQVVQELPGSPAIKKGILQSIKIVDELVKVMG-HAPESIVIEMARENQ TTARGKKNS | 778 |
| WP_009754323 | 703 | SFKEIIQKAQVVG-KTND-LTQVRELSGSPAIKKGILQSIKIVEELVKVMG-YAPESIVIEMARENQ TTAKGKKNS | 776 |
| WP_044674937 | 702 | SFVDEIRLAQGSG-EAED-YRAEVQNLAGSPAIKKGILQSLKIVDELIEVMG-YDPBHIVVEMARENQ FTNQGRRNS | 775 |
| WP_044676715 | 704 | SFVDEIRLAQGSG-EAED-YRAEVQNLAGSPAIKKGILQSLKIVDELIEVMG-YDPEHIVVEMARENQ FTNQGRRNS | 777 |
| WP_044680361 | 704 | SFVDEIRLAQGSG-EAED-YRAEVQNLAGSPAIKKGILQSLKIVDELIEVMG-YDPEHIVEMARENQ FTNQGRRNS | 777 |
| WP_044681799 | 702 | SFVDEIRLAQGSG-EAED-YRAEVQNLAGSPAIKKGILQSLKIVDELVKVMG-YDPEHIVVEMARENQ FTNQGRRNS | 775 |
| WP_049533112 | 704 | SEKEETAKAQVIG-ETDD-LNQVVSDIAGSPAIKKGILQSLKIVDELVKVMG-YNPANIVIEMARENQ TTDKGRRNS | 777 |
| WP_029090905 | 683 | LFKKIIEEQFENtALLN--KQRIDELAASPANKKGIWQATKIVKELEKVLQ-QPAENIFIEFARSDE ES----KRS | 752 |
| WP_065506696 | 706 | GYAQMIEEATSCPeDGKE-TYEEVERLAGSPALKRGIWQSLQIVEEITKVMK-CRPKYIYIEFERSEE ----KERT | 776 |
| AIT42264 | 703 | TEKEDIQAQVSG-QGDS-LHEHIANLAGSPAIKKGIYQSIRIVDEIIRKMK-DRPKNIVIEMARENQ TTQKGQKNS | 777 |
| WP_034440723 | 711 | SFKEKIRKAQDIN-QVND-IKEIVKDLPGSPAIKKGIYQSIRIVDEIIRKMK-DRPKNIVIEMARENQ TTQEGKNKS | 784 |
| AKQ21048 | 703 | TEKEDIQAQVSG-QGDS-LHEHIANLAGSPAIKKGILQTVKVVDELVKVMGrHKPENIVIEMARENQ TTQKGQKNS | 777 |
| WP_004636532 | 707 | SFKKIEDAQTIE-DTTH-IYDTVAELPGSPAIKKGIRQALKIVEEIIDIIG-YEPENIVVEMARESQ TTKKGKDLS | 780 |
| WP_002364836 | 715 | SFKNAIQKAQSSE-HEET-LSETVNELAGSPAIKKGIYQSLKIVDELVAIMG-YAPKRIVVEMARENQ TTSTGKRRS | 788 |
| WP_016631044 | 666 | SFKNAIQKAQSSE-HEET-LSETVNELAGSPAIKKGIYQSLKIVDELVAIMG-YAPKRIVVEMARENQ TTSTGKRRS | 739 |
| EMS75795 | 455 | SFKEELANELALA-GNQS-LLEVVEALLGSPAIKKGIWQTLKIVEELIEIIG-YNPKNIVVEMARENQ RT----NRS | 524 |
| WP_002373311 | 715 | SFKNAIQKAQSSE-HEET-LSETVNELAGSPAIKKGIYQSLKIVDELVAIMG-YAPKRIVVEMARENQ TTSTGKRRS | 788 |
| WP_002378009 | 715 | SFKNAIQKAQSSE-HEET-LSETVNELAGSPAIKKGIYQSLKIVDELVAIMG-YAPKRIVVEMARENQ TTSTGKRRS | 788 |
| WP_002407324 | 715 | SFKNAIQKAQSSE-HEET-LSETVNELAGSPAIKKGIYQSLKIVDELVAIMG-YAPKRIVVEMARENQ TTSTGKRRS | 788 |
| WP_002413717 | 717 | SFKNAIQKAQSSE-HEET-LSETVNELAGSPAIKKGIYQSLKIVDELVAIMG-YAPKRIVVEMARENQ TTSTGKRRS | 790 |
| WP_010777580 | 715 | SFKNAIQKAQSSE-HEET-LSETVNELAGSPAIKKGIYQSLKIVDELVAIMG-YAPKRIVVEMARENQ TTSTGKRRS | 788 |
| WP_010818269 | 715 | SFKNAIQKAQSSE-HEET-LSETVNELAGSPAIKKGIYQSLKIVDELVAIMG-YAPKRIVVEMARENQ TTSTGKRRS | 788 |
| WP_010824395 | 715 | SFKNAIQKAQSSE-HEET-LSETVNELAGSPAIKKGIYQSLKIVDELVAIMG-YAPKRIVVEMARENQ TTSTGKRRS | 788 |
| WP_016622645 | 715 | SFKNAIQKAQSSE-HEET-LSETVNELAGSPAIKKGIYQSLKIVDELVAIMG-YAPKRIVVEMARENQ TTSTGKRRS | 788 |
| WP_033624816 | 715 | SFKNAIQKAQSSE-HEET-LSETVNELAGSPAIKKGIYQSLKIVDELVAIMG-YAPKRIVVEMARENQ TTSTGKRRS | 788 |
| WP_033625576 | 715 | SFKNAIQKAQSSE-HEET-LSETVNELAGSPAIKKGIYQSLKIVDELVAIMG-YAPKRIVVEMARENQ TTSTGKRRS | 788 |
| WP_033789179 | 715 | SFKNAIQKAQSSE-HEET-LSETVNELAGSPAIKKGIYQSLKIVDELVAIMG-YAPKRIVVEMARENQ TTSTGKRRS | 788 |
| WP_002310644 | 715 | SFKNAIQKAQSSE-HEET-LSETVNELAGSPAIKKGIYQSLKIVDELVAIMG-YAPKRIVVEMARENQ TTSTGKRRS | 788 |
| WP_002312694 | 716 | SFKKEIKKAQMIT-DTEN-LEEIVKELTGSPAIKKGILQSLKIVDEIVGIMG-YEPANIVVEMARENQ TTGRLKSS | 789 |
| WP_002314015 | 715 | SFKKEIKKAQMIT-DTEN-LEEIVKELTGSPAIKKGILQSLKIVDEIVGIMG-YEPANIVVEMARENQ TTGRLKSS | 788 |
| WP_002320716 | 716 | SFKKEIKKAQMIT-DTEN-LEEIVKELTGSPAIKKGILQSLKIVDEIVGIMG-YEPANIVVEMARENQ TTGRLKSS | 789 |
| WP_002330729 | 716 | SFKKEIKKAQMIT-DTEN-LEEIVKELTGSPAIKKGILQSLKIVDEIVGIMG-YEPANIVVEMARENQ TTGRLKSS | 789 |
| WP_016622645 | 715 | SFKKEIKKAQMIT-DTEN-LEEIVKELTGSPAIKKGILQSLKIVDEIVGIMG-YEPANIVVEMARENQ TTGRLKSS | 788 |
| WP_002335161 | 716 | SFKKEIKKAQMIT-DTEN-LEEIVKELTGSPAIKKGILQSLKIVDEIVGIMG-YEPANIVVEMARENQ TTGRLKSS | 789 |
| WP_002345439 | 716 | SFKEEIAKATVFS-KHKS-LVDVIQDLPGSPAIKKGIWQSLKIVEELIAIIG-YKPKNIVIEMARENQ TTGRLKSS | 789 |
| WP_034867970 | 711 | SFKEEIAKATVFS-KHKS-LVDVIQDLPGSPAIKKGIWQSLKIVEELIAIIG-YKPKNIVIEMARENQ KT----HRT | 780 |
| WP_047937432 | 711 | SFKEEIAKATVFS-KHKS-LVDVIQDLPGSPAIKKGIWQSLKIVEELIAIIG-YKPKNIVIEMARENQ KT----HRT | 780 |
| WP_010720994 | 711 | SFKKEIKKAQMIT-DTEN-LEEIVKELTGSPAIKKGILQSLKIVDEIVGIMG-YEPANIVVEMARENQ TTGRLKSS | 780 |
| WP_010737004 | 711 | SFKKEIKKAQMIT-DTEN-LEEIVKELTGSPAIKKGILQSLKIVDEIVGIMG-YEPANIVVEMARENQ KT----HRT | 780 |
| WP_034700478 | 708 | SFKKIIEDSQPYK-EQQS-AEEIVSELSGSPAIKKGILQSLKIVDELVAIMG-YKPKNIVEELIGIIG-KAPKNIVIEMARENQ TTGRKQNS | 781 |
| WP_007209003 | 705 | SFKETIANELIMS-DSNV-LLDQVKAIPGSPAVKKGIWQSIKIVEELIGIIG-KAPKNIVIEMARENQ RTSR----S | 774 |
| WP_023519017 | 708 | SFKSEIAEAQSDM-NTED-LHEVVQNLAGSPAIKKGIWQSIKIVDELVDIMG-SLPKNIVVEMARENQ TTSRGRTNS | 781 |
| WP_010770040 | 704 | TFKEEIBKEQLKA-NSEEsLIEIVQNLAGSPAIKKGIFQSLKIVDELVEIMG-YAPTNIVEMARENQ TTANGRRNS | 778 |

```
                                                        -continued

WP_010750235  710 SFKEEIAKELTLS-DKQS-LLEVVEAIPGSPAIKKGIWQTLKIVEELIAIIG-YKPKNIVIEMARENQ TTTGGKNRS      783
AII16583      742 TFKEDIQKAQVSG-QGDS-LHEHIANLAGSPAIKKGILQTVKVVDELVKVMGrHKPENIVIEMARENQ TTQKGQKNS      816
WP_029073316  718 GFKKTIDDANSTSvSGKF-SYAEVQELAGSPAIKRGIWQALLIVDEIKKIMK-HEPAHVYIEFARNED -----KERK      788
WP_031589969  718 GFKKTIDDANSTSvSGKF-SYAEVQELAGSPAIKRGIWQALLIVDEIKKIMK-HEPAHVYIEFARNED -----KERK      788
KDA45870      699 SFKETIKNAQVIE-KEET-LAKTVQELPGSPAIKKGILQSLEIVDEIIKVMG-YKPKSIVVEMARETQ --THGTRKR      771
WP_039099354  713 DFDKLITEANQMM-LAENdVQDVINDLYTSPQNKKALRQILVVNDIQKAMKgQAPERILIEFAREDE VNPRLSVQR      788
AKP02966      707 DFKNYIENHNLNKnEDQN-ISNLVNDIHVSPALKRGITQSIKIVQEIVKFMG-HAPKYIFIEVTRETK TTSRGKRIQ      785
WP_010991369  707 SFKSIIEKEQVTT-ADKD-IQSIVADLAGSPAIKKGILQSLKIVDELVSVMG-YPPQTIVVEMARENQ TTGKGKNNS      780
WP_033838504  707 SFKSIIEKEQVTT-ADKD-IQSIVADLAGSPAIKKGILQSLKIVDELVSVMG-YPPQTIVVEMARENQ TTGKGKNNS      780
EHN60060      710 SFKSIIEKEQVTT-ADKD-IQSIVADLAGSPAIKKGILQSLKIVDELVSVMG-YPPQTIVVEMARENQ TTGKGKNNS      783
EFR89594      476 SFKSIIEKEQVTT-ADKD-IQSIVADLAGSPAIKKGILQSLKIVDELVSVMG-YPPQTIVVEMARENQ TTGKGKNNS      549
WP_038409211  707 SFKSIIEKEQVST-ADKG-IQSIVAELAGSPAIKKGILQSLKIVDELVGIMG-YPPQTIVVEMARENQ TTGKGKNNS      780
EFR95520      326 SFKSIIEKEQVST-ADKG-IQSIVAELAGSPAIKKGILQSLKIVDELVGIMG-YPPQTIVVEMARENQ TTGKGKNNS      399
WP_003723650  707 SFKSIIEKEQVST-TDKD-LQSIVADLAGSPAIKKGILQSLKIVDELVSIMG-YPPQTIVVEMARENQ TTGKGKNNS      780
WP_003727705  707 SFKSIIEKEQVST-TDKD-LQSIVADLAGSPAIKKGILQSLKIVDELVSIMG-YPPQTIVVEMARENQ TTGKGKNNS      780
WP_003730785  707 SFKSIIEKEQVST-TDKD-LQSIVADLAGSPAIKKGILQSLKIVDELVSIMG-YPPQTIVVEMARENQ TTGKGKNNS      780
WP_003733029  707 SFKSIIEKEQVST-TDKD-LQSIVADLAGSPAIKKGILQSLKIVDELVSIMG-YPPQTIVVEMARENQ TTGKGKNNS      780
WP_003739838  707 SFKSIIEKEQVST-TDKD-LQSIVADLAGSPAIKKGILQSLKIVDELVSIMG-YPPQTIVVEMARENQ TTGKGKNNS      780
WP_014601172  707 SFKSIIEKEQVST-TDKD-LQSIVADLAGSPAIKKGILQSLKIVDELVSIMG-YPPQTIVVEMARENQ TTVKGKNNS      780
WP_023548323  707 SFKSIIEKEQVST-ADKD-LQSIVADLAGSPAIKKGILQSLKVVEELVSVMG-YPPQTIVVEMARENQ TTNKGKNNS      780
WP_031665337  707 SFKSIIEKEQVST-TDKD-LQSIVAELAGSPAIKKGILQSLKIVDELVSIMG-YPPQTIVVEMARENQ TTNKGKNNS      780
WP_031669209  707 SFKSIIEKEQVST-ADKD-LQSIVADLAGSPAIKKGILQSLKIVDELVSVMG-YPPQTIVVEMARENQ TTNKGKNNS      780
WP_033920898  707 SFKSIIEKEQVST-TDKD-LQSIVADLAGSPAIKKGILQSLKIVEELVSVMG-YPPQTIVVEMARENQ TTGKGKNNS      780
AKI42028      710 SFKSIIEKEQVST-ADKD-LQSIVADLAGSPAIKKGILQSLKIVDELVSIMG-YPPQTIVVEMARENQ TTGKGKNNS      783
AKI50529      710 SFKSIIEKEQVST-ADKD-LQSIVADLAGSPAIKKGILQSLKIVDELVSIMG-YPPQTIVVEMARENQ TTGKGKNNS      783
EFR83390      155 SFKSIIEKEQVST-TDKD-LQSIVADLAGSPAIKKGILQSLKIVDELVGIMG-YPPQTIVVEMARENQ TTVKGKNNS      228
WP_046323366  707 SFKSIIEKEQVST-ADKD-LQSIVADLAGSPAIKKGILQSLKIVDELVSIMG-YPPQTIVVEMARENQ TTGKGKNNS      780
AKE81011      719 TFKEDIQKAQVSG-QGDS-LHEHIANLAGSPAIKKGILQTVKVVDELVKVMGrHKPENIVIEMARENQ TTQKGQKNS      793
CUO82355      710 GYAQMIEEASSCPhDGKF-TYEEVAKLAGSPALRGIWQSLQIVEEITKVMK-CRPKYIYIEPERSEE -----KERT      780
WP_033162887  713 GYKQIIEESNMQDiEGPF-KYDEVKKLAGSPAIKKGIWQALLVVREITKFMK-HEPSHIYIEFAREEQ -----KVRK      783
AGZ01981      736 TFKEDIQKAQVSG-QGDS-LHEHIANLAGSPAIKKGILQTVKVVDELVKVMGrHKPENIVIEMARENQ TTQKGQKNS      810
AKA60242      703 TFKEDIQKAQVSG-QGDS-LHEHIANLAGSPAIKKGILQTVKVVDELVKVMGrHKPENIVIEMARENQ TTQKGQKNS      777
AKS40380      703 TFKEDIQKAQVSG-QGDS-LHEHIANLAGSPAIKKGILQTVKVVDELVKVMGrHKPENIVIEMARENQ TTQKGQKNS      777
4UN5_B        707 TFKEDIQKAQVSG-QGDS-LHEHIANLAGSPAIKKGILQTVKVVDELVKVMGrHKPENIVIEMARENQ TTQKGQKNS      781
WP_010922251  778 RERMKRIEEGIK ELGS QILKEHP--VE---NTQLQNEKLYLYYLQNGRDMYVDQEL--D--INRLSDYDVDHI        841
QQRLKKLQNSLK PSYI E---DK--VE---NSHLQNDQLFIGYIQNGKDMYTGDEL--D--IDHLSDYDIDHI        851
QQRYKRIEDSLK ILAS NILKENP--TD---NNQLQNDRLFLYYLQNGKDMYTEAL--D--INQLSSYDIDHI        843
KDAQKMINEMQK QTNE EIIRTTGk--E---NAKYLIEKIKLHDMQEGKCLYSLEAIp1EGilLNNPFNYEVDHI        561
RERMKRIEEGIK ELGS DILKEYP--VE---NTQLQNEKLYLYYLQNGRDMYVDQEL--D--INRLSDYDVDHI        525
WP_010922251  778 RERMKRIEEGIK ELGS QILKEHP--VE---NTQLQNEKLYLYYLQNGRDMYVDQEL--D--INRLSDYDVDHI        841
WP_011054416  778 RERMKRIEEGIK ELGS DILKEYP--VE---NTQLQNEKLYLYYLQNGRDMYVDQEL--D--INRLSDYDVDHI        841
WP_011284745  778 RERMKRIEEGIK ELGS QILKEHP--VE---NTQLQNEKLYLYYLQNGRDMYVDQEL--D--INRLSDYDVDHI        841
WP_011285506  778 RERMKRIEEGIK ELGS QILKEHP--VE---NTQLQNEKLYLYYLQNGRDMYVDQEL--D--INRLSDYDVDHI        841
WP_011527619  778 RERMKRIEEGIK ELGS QILKEHP--VE---TTQLQNEKLYLYYLQNGRDMYVDQEL--D--INRLSDYDVDHI        841
WP_012560673  778 RERMKRIEEGIK ELGS DILKEYP--VE---TTQLQNEKLYLYYLQNGRDMYVDQEL--D--INRLSDYDVDHI        841
WP_014407541  777 RERMKRIEEGIK ELGS QILKEHP--VE---NTQLQNEKLYLYYLQNGRDMYVDQEL--D--INRLSDYDVDHI        840
WP_020905136  778 RERMKRIEEGIK ELGS QILKEHP--VE---NTQLQNEKLYLYYLQNGRDMYVDQEL--D--INRLSDYDVDHI        841
WP_023080005  777 RERMKRIEEGIK ELGS QILKEHP--VE---NTQLQNEKLYLYYLQNGRDMYVDQEL--D--INRLSDYDVDHI        840
WP_023610282  777 RERMKRIEEGIK ELGS DILKEYP--VE---NTQLQNEKLYLYYLQNGRDMYVDQEL--D--INRLSDYDVDHI        840
WP_030125963  778 RERMKRIEEGIK ELGS DILKEYP--VE---NTQLQNEKLYLYYLQNGRDMYVDQEL--D--INRLSDYDVDHI        841
WP_030126706  778 RERMKRIEEGIK ELGS DILKEYP--VE---NTQLQNEKLYLYYLQNGRDMYVDQEL--D--INRLSDYDVDHI        841
WP_031488318  778 RERMKRIEEGIK ELGS DILKEYP--VE---NTQLQNEKLYLYYLQNGRDMYVDQEL--D--INRLSDYDVDHI        841
WP_032460140  778 RERMKRIEEGIK ELGS DILKEYP--VE---NTQLQNEKLYLYYLQNGRDMYVDQEL--D--INRLSDYDVDHI        841
```

| ID | Start | Sequence | End |
|---|---|---|---|
| WP_032461047 | 778 | RERMKRIEEGIK ELGS DILKEYP -VE- -NTQLQNEKLYLYYLQNGRDMVDQEL--D--INRLSDYDVDHI | 841 |
| WP_032462016 | 778 | RERMKRIEEGIK ELGS QILKEHP -VE- -NTQLQNEKLYLYYLQNGRDMVDQEL--D--INRLSDYDVDHI | 841 |
| WP_032462936 | 778 | RERMKRIEEGIK ELGS DILKEYP -VE- -NTQLQNEKLYLYYLQNGRDMVDQEL--D--INRLSDYDVDHI | 841 |
| WP_032464890 | 778 | RERMKRIEEGIK ELGS QILKEHP -VE- -NTQLQNEKLYLYYLQNGRDMVDQEL--D--INRLSDYDVDHI | 841 |
| WP_033888930 | 603 | RERMKRIEEGIK ELGS QILKEHP -VE- -NTQLQNEKLYLYYLQNGRDMVDQEL--D--INRLSDYDVDHI | 666 |
| WP_038431314 | 778 | RERMKRIEEGIK ELGS DILKEYP -VE- -NTQLQNEKLYLYYLQNGRDMVDQEL--D--INRLSDYDVDHI | 841 |
| WP_038432938 | 777 | RERMKRIEEGIK ELGS QILKEHP -VE- -NTQLQNEKLYLYYLQNGRDMVDQEL--D--INRLSDYDVDHI | 840 |
| WP_038434062 | 778 | RERMKRIEEGIK ELGS DILKEYP -VE- -NTQLQNEKLYLYYLQNGRDMVDQEL--D--INRLSDYDVDHI | 841 |
| BAQ51233 | 689 | RERMKRIEEGIK ELGS QILKEHP ---- ----------------------QEL--D--INRLSGYDVDHI | 752 |
| KGE60162 | 1 | ------------ ---- ------- ---- -------------------------------------- | 16 |
| KGE60856 | | | |
| WP_002989955 | 778 | RERMKRIEEGIK ELGS QILKEHP -VE- -NTQLQNEKLYLYYLQNGRDMVDQEL--D--INRLSDYDVDHI | 841 |
| WP_003030002 | 778 | QQRLKLLQDSLK PVNI K---- -N-- -NQQLQNDRLFLYYIQNGKDMYTGETL--D--INNLSDYDIDHI | 840 |
| WP_003065552 | 781 | QQRLKKLQNSLK PSYI E---- -DK- -NSHLQNDQLFLYYIQNGKDMYTGDEL--D--IDHLSDYDIDHI | 851 |
| WP_001040076 | 776 | RQRLTTLRESLA NLKS EKKPKYV KDqveNHHLSDDRLFLYYLQNGKDMYTDDEL--D--IDNLSQYDIDHI | 846 |
| WP_001040078 | 779 | RQRYKLLDDGVK NLAS NILKEYP -TD- -NQALQNERLFLYYLQNGRDMYTGEAL--D--IDNLSQYDIDHI | 846 |
| WP_001040080 | 779 | RQRYKLLDDGVK NLAS NILKEYP -TD- -NQALQNERLFLYYLQNGRDMYTGEAL--D--IDNLSQYDIDHI | 846 |
| WP_001040081 | 779 | RQRYKLLDDGVK NLAS NILKEYP -TD- -NQALQNERLFLYYLQNGRDMYTGEAL--D--IDNLSQYDIDHI | 846 |
| WP_001040083 | 779 | RQRYKLLDDGVK NLAS NILKEYP -TD- -NQALQNERLFLYYLQNGRDMYTGEAL--D--IDDLSQYDIDHI | 846 |
| WP_001040085 | 779 | RQRYKLLDDGVK NLAS NILKEYP -TD- -NQALQNERLFLYYLQNGRDMYTGEAL--D--IDNLSQYDIDHI | 846 |
| WP_001040087 | 779 | RQRYKLLDDGVK NLAS NILKEYP -TD- -NQALQNERLFLYYLQNGRDMYTGEAL--D--IDNLSQYDIDHI | 846 |
| WP_001040088 | 779 | RQRYKLLDDGVK NLAS NILKEYP -TD- -NQALQNERLFLYYLQNGRDMYTGEAL--D--IDNLSQYDIDHI | 846 |
| WP_001040089 | 779 | RQRYKLLDDGVK NLAS NILKEYP -TD- -NQALQNERLFLYYLQNGRDMYTGEAL--D--IDNLSQYDIDHI | 846 |
| WP_001040090 | 779 | RQRYKLLDDGVK NLAS NILKEYP -TD- -NQALQNERLFLYYLQNGRDMYTGEAL--D--IDNLSQYDIDHI | 846 |
| WP_001040091 | 779 | RQRYKLLDDGVK NLAS NILKEYP -TD- -NQALQNERLFLYYLQNGRDMYTGEAL--D--IDNLSQYDIDHI | 846 |
| WP_001040092 | 779 | RQRYKLLEDGVK NLAS DILKEYP -TD- -NQALQNERLFLYYLQNGRDMYTGEAL--D--IDNLSQYDIDHI | 846 |
| WP_001040094 | 776 | RQRLTTLRESLA NLKS EKKPKYV KDqveNHHLSDDRLFLYYLQNGKDMYTDDEL--D--IDNLSQYDIDHI | 846 |
| WP_001040095 | 776 | RQRLTTLRESLA NLKS EKKPKYV KDqveNHHLSDDRLFLYYLQNGKDMYTDDEL--D--IDNLSQYDIDHI | 846 |
| WP_001040096 | 776 | RQRLTTLRESLA NLKS EKKPKYV KDqveNHHLSDDRLFLYYLQNGKDMYTDDEL--D--IDNLSQYDIDHI | 846 |
| WP_001040097 | 776 | RQRLTTLRESLA NLKS EKKPKYV KDqveNHHLSDDRLFLYYLQNGKDMYTDDEL--D--IDNLSQYDIDHI | 846 |
| WP_001040098 | 779 | RQRYKLLDDGVK NLAS NILKEYP -TD- -NQALQNERLFLYYLQNGRDMYTGEAL--D--IDNLSQYDIDHI | 846 |
| WP_001040099 | 779 | RQRYKLLDDGVK NLAS NILKEYP -TD- -NQALQNERLFLYYLQNGRDMYTGEAL--D--IDNLSQYDIDHI | 846 |
| WP_001040100 | 779 | RQRYKLLDDGVK NLAS NILKEYP -TD- -NQALQNERLFLYYLQNGRDMYTGEAL--D--IDNLSQYDIDHI | 846 |
| WP_001040104 | 776 | RQRLTTLRESLA NLKS EKKPKYV KDqveNHHLSDDRLFLYYLQNGKDMYTDDEL--D--IDNLSQYDIDHI | 846 |
| WP_001040105 | 779 | RQRYKLLDDGVK NLAS NILKEYP -TD- -NQALQNERLFLYYLQNGRDMYTGEAL--D--IDNLSQYDIDHI | 846 |
| WP_001040106 | 779 | RQRYKLLEEGVK NLAS NILKEYP -TD- -NQALQNERLFLYYLQNGRDMYTGEAL--D--IDNLSQYDIDHI | 846 |
| WP_001040107 | 779 | RQRYKLLEEGVK NLAS NILKEYP -TD- -NQALQNERLFLYYLQNGRDMYTGETL--D--IDNLSQYDIDHI | 846 |
| WP_001040108 | 779 | RQRYKLLEEGVK NLAS NILKEYP -TD- -NQALQNERLFLYYLQNGRDMYTGEAL--D--IDNLSQYDIDHI | 846 |
| WP_001040109 | 779 | RQRYKLLEEGVK NLAS NILKEYP -TD- -NQALQNERLFLYYLQNGRDMYTGEAL--D--IDNLSQYDIDHI | 846 |
| WP_001040110 | 779 | RQRYKLLEEGVK NLAS DILKEYP -TD- -NQALQNERLFLYYLQNGRDMYTGEAL--D--IDNLSQYDIDHI | 846 |
| WP_015058523 | 779 | RQRYKLLEEGVK NLAS NILKEYP -TD- -NQALQNERLFLYYLQNGRDMYTGEAL--D--IDNLSQYDIDHI | 846 |
| WP_017643650 | 776 | RQRLTTLRESLA NLKS EKKPKYV KDqveNHHLSDDRLFLYYLQNGKDMYTDDEL--D--IDNLSQYDIDHI | 846 |
| WP_017647151 | 779 | RQRYKLLDDGVK NLAS NILKEYP -TD- -NQALQNERLFLYYLQNGRDMYTGKAL--D--IDNLSQYDIDHI | 846 |
| WP_017648376 | 779 | RQRYKLLDDGVK NLAS NILKEYP -TD- -NQALQNERLFLYYLQNGRDMYTGEAL--D--IDNLSQYDIDHI | 846 |
| WP_017649527 | 779 | RQRYKLLEEGVK NLAS NILKEYP -TD- -NQALQNERLFLYYLQNGRDMYTGEAL--D--IDNLSQYDIDHI | 846 |
| WP_017771611 | 779 | RQRYKLLEEGVK NLAS NILKEYP -TD- -NQALQNERLFLYYLQNGRDMYTGEAL--D--IDNLSQYDIDHI | 846 |
| WP_017771984 | 779 | RQRYKLLEEGVK NLAS NILKEYP -TD- -NQALQNERLFLYYLQNGRDMYTGEAL--D--IDNLSQYDIDHI | 846 |
| CFQ25032 | 779 | RQRYKLLDDGVK NLAS NILKEYP -TD- -NQALQNERLFLYYLQNGRDMYTGEAL--D--IDNLSQYDIDHI | 846 |
| CFV16040 | 779 | RQRYKLLDDGVK NLAS NILKEYP -TD- -NQALQNERLFLYYLQNGRDMYTGEAL--D--IDNLSQYDIDHI | 846 |
| KLJ37842 | 779 | RQRYKLLDDGVK NLAS NILKEYP -TD- -NQALQNERLFLYYLQNGRDMYTGEAL--D--IDNLSQYDIDLI | 846 |
| KLJ72361 | 779 | RQRYKLLDDGVK NLAS NILKEYP -TD- -NQALQNERLFLYYLQNGRDMYTGEAL--D--IDNLSQYDIDHI | 846 |
| KLL20707 | 793 | RQRYKLLDDGVK NLAS NILKEYP -TD- -NQALQNERLFLYYLQNGRDMYTGEAL--D--IDNLSQYDIDHI | 860 |
| KLL42645 | 779 | RQRYKLLEEGVK NLAS NILKEYP -TD- -NQALQNERLFLYYLQNGRDMYTGEAL--D--IDNLSQYDIDHI | 846 |

| | | | | |
|---|---|---|---|---|
| WP_047202273 | 779 | RQRYKLLDDGVK NLAS NILKEYP-TD---NQALQNERLFLYYLQNGRDMYTGEAL--D--IDNLSQYDIDHI | 846 |
| WP_047209694 | 776 | RQRLTTLRESLA NLKS EKKPKYV-KDqveNHHLSDDRLFLYYLQNGKDMYTDDEL--D--IDNLSQYDIDHI | 846 |
| WP_050198062 | 779 | RQRYKLLDDGVK NLAS NILKEYP-TD---NQALQNERLFLYYLQNGRDMYTGEAL--D--IDNLSQYDIDHI | 846 |
| WP_050201642 | 779 | RQRYKLLDDGVK NLAS NILKEYP-TD---NQALQNERLFLYYLQNGRDMYTGEAL--D--IDNLSQYDIDHI | 846 |
| WP_050204027 | 779 | RQRYKLLEEGVK NLAS NILKEYP-TD---NQALQNERLFLYYLQNGRDMYTGEAL--D--IDNLSQYDIDHI | 846 |
| WP_050881965 | 779 | RQRYKLLDDGVK NLAS NILKEYP-TD---NQALQNERLFLYYLQNGRDMYTGEAL--D--IDNLSQYDIDHI | 846 |
| WP_050886065 | 779 | RQRYKLLDDGVK NLAS NILKEYP-TD---NQALQNERLFLYYLQNGRDMYTGEAL--D--IDNLSQYDIDHI | 846 |
| AHN30376 | 779 | RQRYKLLEDGVK NLAS DILKEYP-TD---NQALQNERLFLYYLQNGRDMYTGEAL--D--IDSLSQYDIDHI | 846 |
| EA078426 | 779 | RQRYKLLDDGVK NLAS NILKEYP-TD---NQALQNERLFLYYLQNGRDMYTEKAL--D--IDNLSQYDIDHI | 846 |
| CCW42055 | 779 | RQRYKLLDDGVR NLAS NILKEYP-TD---NQALQNERLFLYYLQNGRDMYTDDEL--D--IDNLSQYDIDHI | 846 |
| WP_003041502 | 778 | QQRLKLLQDSLK PVNI K------N-VE---NQQLQNDRLFLYYIQNGKDMYTGETL--D--INNLSQYDIDHI | 840 |
| WP_037593752 | 779 | QQRLKLLQDSLK PVNI K------N-VE---NQQLQNDRLFLYYIQNGKDMYTGETL--D--INNLSQYDIDHI | 841 |
| WP_049516684 | 779 | QQRLKLLQDSLK PVNI K------N-VE---NQQLQNDRLFLYYIQNGKDMYTGETL--D--INNLSQYDIDHI | 841 |
| GAD46167 | 778 | QQRLKLLQDSLK PSVI K------N-VE---NQQLQNDRLFLYYIQNGKDMYTGETL--D--IDHLSDYDIDHI | 840 |
| WP_018363470 | 779 | QQRLKLLQNSLK PSYI E---DK-N-VE---NSHLQNDQLFLYYIQNGKDMYTGDEL--D--INNLSQYDIDHI | 849 |
| WP_003043819 | 787 | RERKKRIEGIK ELES QILKENP-VE---NTQLQNEKLYLYYLQNGRDMYTVDQEL--D--INRLSDYDVDHI | 850 |
| WP_006269658 | 779 | QQRLKLLQDSLK PVNI K------N-VE---NQQLQNDRLFLYYIQNGKDMYTVDQEL--D--INNLSQYDIDHI | 840 |
| WP_048800889 | 778 | QQRLKLLQDSLT PVSI K------N-VE---NQQLQNEKLYLYYLQNGRDMYTGETL--D--IHHLSDYDIDHI | 840 |
| WP_012767106 | 778 | RERMKRIEGIK ELGS QILKEHP-VE---NTQLQNEKLYLYYLQNGRDMYTGEEL--D--INRLSDYDVDHI | 840 |
| WP_014612333 | 777 | RERMKRIEGIK ELGS QILKEHP-VE---NTQLQNEKLYLYYLQNGRDMYTVDQEL--D--INRLSDYDVDHI | 840 |
| WP_015017095 | 777 | RERMKRIEGIK ELGS QILKEHP-VE---NTQLQNEKLYLYYLQNGRDMYTVDQEL--D--INRLSDYDVDHI | 840 |
| WP_015057649 | 777 | RERMKRIEGIK ELGS QILKEHP-VE---NTQLQNEKLYLYYLQNGRDMYTVDQEL--D--INRLSDYDVDHI | 840 |
| WP_048277215 | 777 | RERMKRIEGIK ELGS QILKEHP-VE---NTQLQNEKLYLYYLQNGRDMYTVDQEL--D--IDYLSDYDVDHI | 840 |
| WP_049519324 | 777 | RERMKRIEGIK ELGS QILKEHP-VE---NTQLQNEKLYLYYLQNGRDMYTVDQEL--D--IDYLSDYDVDHI | 840 |
| WP_012515931 | 777 | RQRMRKLEETAK KLGS NILKEHP-VD---NSQLQNDKRYLYLYYLQNGRDMYTGDDL--D--IDYLSSYDIDHI | 840 |
| WP_021320964 | 777 | RQRMRKLEETAK KLGS NILKEHP-VD---NSQLQNDKRYLYLYYLQNGRDMYTGDDL--D--IDYLSSYDIDHI | 840 |
| WP_037581760 | 778 | NQRLKRLQDSLK PSYV D-----SK-VE---NSHLQNDQLFLYYIQNGKDMYTGDEL--D--IDHLSDYDIDHI | 848 |
| WP_009854540 | 779 | QQRLKKLQSSLK PSYI E-----DK-VE---NSHLQNDQLFLYYIQNGKDMYTGDEL--D--IDRLSDYDIDHI | 849 |
| WP_012962174 | 779 | QQRLKKLQNSLK PSYI D-----SK-VE---NSHLQNDQLFLYYIQNGKDMYTGDEL--D--IDRLSDYDIDHI | 849 |
| WP_039693303 | 781 | NQRLKRLQDSLK PSYV D-----SK-VE---NTQLQSDRLYLYLLQDGKDMYTGKEL--D--YDNLSQYDIDHI | 851 |
| WP_014334983 | 778 | RQRLRKLEEVHK NTGS KILKEYN-VS---NTQLQSDRLYLYLLQDGKDMYTGKEL--D--YDNLSQYDIDHI | 848 |
| WP_003099269 | 778 | RQRLRKLEEVHK NTGS KILKEYN-VS---NTQLQSDRLYLYLLQDGKDMYTGKEL--D--YDNLSQYDIDHI | 841 |
| AHY15608 | 778 | RQRLRKLEEVHK NTGS KILKEYN-VS---NTQLQSDRLYLYLLQDGKDMYTGKEL--D--YDNLSQYDIDHI | 841 |
| AHY17476 | | | |
| ESR09100 | | | |
| AGM98575 | 778 | RQRLRKLEEVHK NTGS KILKEYN-VS---NTQLQSDRLYLYLLQDGKDMYTGKEL--D--YDNLSQYDIDHI | 841 |
| ALF27331 | 778 | QQRLKGLTDSIK EFGS QILKEHP-VE---NSQLQNDRLFLYYLQNGRDMYTGEEL--D--IDYLSQYDIDHI | 841 |
| WP_018372492 | 791 | AQRLKLKKIEDGIK -LGS DLLKQNP-IQd--NKDLQKEKLFLYYMQNGIDLYTGQPLncD--PDSLAFYDVDHI | 857 |
| WP_045618028 | 777 | QQRYKIRIEDALK NLAH NILKEHP-TD---NNQLQNDRLFLYYIQNGKDMYTGEAL--D--INQLSSYDIDHI | 844 |
| WP_045635197 | 776 | QQRLIKLEDSLK ILAS NILKEYP-VE---NSQLQNDRLFLYYIQNGKDMYTGKSL--D--INQLSSYDIDHI | 843 |
| WP_002263887 | 778 | QQRLKGLTDSIK EFGS QILKEHP-VE---NSQLQNDRLFLYYLQNGRDMYTGEEL--D--IDYLSQYDIDHI | 841 |
| WP_002644920 | 778 | QQRLKGLTDSIK EFGS QILKEHP-VE---NSQLQNDRLFLYYLQNGRDMYTGEEL--D--IDYLSQYDIDHI | 841 |
| WP_002269043 | 778 | QQRLKGLTDSIK EFGS QILKEHP-VE---NSQLQNDRLFLYYLQNGRDMYTGEEL--D--IDYLSQYDIDHI | 841 |
| WP_002269448 | 778 | QQRLKGLTDSIK EFGS QILKEHP-VE---NSQLQNDRLFLYYLQNGRDMYTGEEL--D--IDYLSQYDIDHI | 841 |
| WP_002271977 | 778 | QQRLKGLTDSIK EFGS QILKEHP-VE---NSQLQNDRLFLYYLQNGRDMYTGEEL--D--IDYLSQYDIDHI | 841 |
| WP_002272766 | 778 | QQRLKGLTDSIK EFGS QILKEHP-VE---NSQLQNDRLFLYYLQNGRDMYTGEEL--D--IDYLSQYDIDHI | 841 |
| WP_002273241 | 778 | QQRLKGLTDSIK EFGS QILKEHP-VE---NSQLQNDRLFLYYLQNGRDMYTGEEL--D--IDYLSQYDIDHI | 841 |
| WP_002275430 | 778 | QQRLKGLTDSIK EFGS QILKEHP-VE---NSQLQNDRLFLYYLQNGRDMYTGEEL--D--IDYLSQYDIDHI | 841 |
| WP_002276448 | 778 | QQRLKGLTDSIK EFGS QILKEHP-VE---NSQLQNDRLFLYYLQNGRDMYTGESL--D--INRLSQYDIDHI | 841 |
| WP_002277050 | 779 | QQRYKRLKEAIK DLNH KILKEHP-TD---NQALQNNRLFLYYLQNGRDMYTGEEL--D--INRLSDYDIDHV | 846 |
| WP_002277364 | 778 | QQRLKGLTDSIK EFGS QILKEHP-VE---HSQLQNDRLFLYYLQNGRDMYTGEEL--D--IDYLSQYDIDHI | 841 |

| Accession | Start | Sequence | End |
|---|---|---|---|
| WP_002279025 | 778 | QQRLKGLTDSIK EFGS QILKEHP-VE---NSQLQNDRLFLYYLQNGRDMYTGEEL--D--IDYLSQYDIDHI | 841 |
| WP_002279859 | 778 | QQRLKGLTDSIK EFGS QILKEHP-VE---NSQLQNDRLFLYYLQNGRDMYTGEEL--D--IDYLSQYDIDHI | 841 |
| WP_002280230 | 778 | QQRLKGLTDSIK EFGS QILKEHP-VE---NSQLQNDRLFLYYLQNGRDMYTGEEL--D--IDYLSQYDIDHI | 841 |
| WP_002281696 | 778 | QQRLKGLTDSIK DLNH KILKEHP-TD---NQALQNDRLFLYYLQNGRDMYTGEEL--D--INRLSDYDIDHV | 846 |
| WP_002282247 | 779 | QQRYKRLKEAIK EFGS QILKEHP-VE---NSQLQNDRLFLYYLQNGRDMYTGESL--D--INRLSDYDIDHI | 841 |
| WP_002283846 | 778 | QQRLKGLTDSIK EFGS QILKEHP-VE---NSQLQNDRLFLYYLQNGRDMYTGEEL--D--IDYLSQYDIDHI | 841 |
| WP_002287255 | 778 | QQRLKGLTDSIK EFGS QILKEHP-VE---HSQLQNDRLFLYYLQNGRDMYTGEEL--D--IDYLSQYDIDHI | 841 |
| WP_002288990 | 778 | QQRLKGLTDSIK EFGS QILKEHP-VE---NSQLQNDRLFLYYLQNGRDMYTGEEL--D--IDYLSQYDIDHI | 841 |
| WP_002289641 | 778 | QQRLKGLTDSIK EFGS QILKEHP-VE---NSQLQNDRLFLYYLQNGRDMYTGEEL--D--IDYLSQYDIDHI | 841 |
| WP_002290427 | 778 | QQRLKGLTDSIK EFGS QILKEHP-VE---NSQLQNDRLFLYYLQNGRDMYTGEEL--D--IDYLSQYDIDHI | 841 |
| WP_002295753 | 778 | QQRLKGLTDSIK EFGS QILKEHP-VE---NSQLQNDRLFLYYLQNGRDMYTGEEL--D--IDYLSQYDIDHI | 841 |
| WP_002296423 | 778 | QQRLKGLTDSIK EFGS QILKEHP-VE---NSQLQNDRLFLYYLQNGRDMYTGEEL--D--IDYLSQYDIDHI | 841 |
| WP_002304487 | 788 | QKRYKRLEEAIK DLNH KILKEHP-TD---NQALQNDRLFLYYLQNGRDMYTEDPL--D--INRLSDYDIDHI | 855 |
| WP_002305844 | 778 | QQRLKGLTDSIK EFGS QILKEHP-VE---NSQLQNDRLFLYYLQNGRDMYTGEEL--D--IDYLSQYDIDHI | 841 |
| WP_002307203 | 778 | QQRLKGLTDSIK EFGS QILKEHP-VE---NSQLQNDRLFLYYLQNGRDMYTGEEL--D--IDYLSQYDIDHI | 841 |
| WP_002310390 | 778 | QQRLKGLTDSIK EFGS QILKEHP-VE---NSQLQNDRLFLYYLQNGRDMYTGEEL--D--IDYLSQYDIDHI | 841 |
| WP_002352408 | 778 | QQRLKGLTDSIK EFGS QILKEHP-VE---NSQLQNDRLFLYYLQNGRDMYTGEEL--D--IDYLSQYDIDHI | 841 |
| WP_012997688 | 778 | QQRLKGLTDSIK EFGS QILKEHP-VK---NSQLQNDRLFLYYLQNGRDMYTGEEL--D--IDYLSQYDIDHI | 841 |
| WP_014677909 | 778 | QQRLKGLTDSIK EFGS QILKEHP-VE---NSQLQNDRLFLYYLQNGRDMYTGEEL--D--INRLSDYDIDHV | 846 |
| WP_019312892 | 778 | QQRLKGLTDSIK EFGS QILKEHP-VE---NSQLQNDRLFLYYLQNGRDMYTGEEL--D--IDYLSQYDIDHI | 841 |
| WP_019313659 | 778 | QQRLKGLTDSIK EFGS QILKEHP-VE---NSQLQNDRLFLYYLQNGRDMYTGEEL--D--IDYLSQYDIDHI | 841 |
| WP_019314093 | 778 | QQRLKGLTDSIK EFGS QILKEHP-TD---NQALQNDRLFLYYLQNGRDMYTGEEL--D--INRLSDYDIDHI | 846 |
| WP_019315370 | 778 | QQRLKGLTDSIK EFGS QILKEHP-VE---NSQLQNDRLFLYYLQNGRDMYTGEEL--D--IDYLSQYDIDHI | 841 |
| WP_019803776 | 778 | QQRLKGLTDSIK DLNH KILKEHP-TD---HSQLQNDRLFLYYLQNGRDMYTGESL--D--IDYLSQYDIDHV | 846 |
| WP_019805234 | 778 | QQRLKGLTDSIK EFGS QILKEHP-VE---NSQLQNDRLFLYYLQNGRDMYTGEEL--D--IDYLSQYDIDHI | 841 |
| WP_024783594 | 778 | QQRLKGLTDSIK EFGS QILKEHP-VE---NSQLQNDRLFLYYLQNGRDMYTGEEL--D--IDYLSQYDIDHI | 841 |
| WP_024784288 | 779 | QQRYKRLKEAIK DLNH KILKEHP-TD---NQALQNDRLFLYYLQNGRDMYTGEEL--D--INRLSDYDIDHI | 846 |
| WP_024784666 | 778 | QQRLKGLTDSIK EFGS QILKEHP-VE---HSQLQNDRLFLYYLQNGRDMYTGEEL--D--IDYLSQYDIDHI | 841 |
| WP_024784894 | 778 | QQRLKGLTDSIK EFGS QILKEHP-VE---NSQLQNDRLFLYYLQNGRDMYTGESL--D--IDYLSQYDIDHI | 841 |
| WP_024786433 | 779 | QQRYKRLKEAIK DLNH KILKEHP-TD---NQALQNDRLFLYYLQNGRDMYTGEEL--D--INRLSDYDIDHV | 846 |
| WP_049473442 | 778 | QQRLKGLTDSIK EFGS QILKEHP-VE---NSQLQNDRLFLYYLQNGRDMYTGEEL--D--IDYLSQYDIDHI | 841 |
| WP_049474547 | 778 | QQRLKGLTDSIK EFGS QILKEHP-VE---NSQLQNDRLFLYYLQNGRDMYTGEEL--D--IDYLSQYDIDHI | 841 |
| EMC03581 | 771 | RERLRKLEEVHK NIGS KILKEHE-IS---NAQLQSDRVYLYLLQDGKDMYTGEDL--D--FDRLSQYDIDHI | 834 |
| WP_000428612 | 779 | QQRYKRIEDSLK ILAS NILKEHP-TD---NIQLQNDRLYLYLQNGKDMYTGKPL--D--INQLSSYDIDHI | 846 |
| WP_000428613 | 777 | QQRYKRIEDALK NLAS NILKEHP-TN---NIQLKNDRLYLYLQNGKDMYTGKPL--D--INQLSSYDIDHI | 844 |
| WP_049523028 | 776 | QQRLKTLSDAIS ELG- NILKEHP-TD---NIQLQNDRLYLYLQNGKDMYTGEAL--D--INQLSNYDIDHI | 839 |
| WP_003107102 | 747 | RERLRKLEEVHK NIGS KILKEHE-IS---NAQLQSDRVYLYLLQDGKDMYTGKDL--D--ISNLSHYDIDHI | 810 |
| WP_054279288 | 779 | RERMKRVQEVLK KLGS QLLKEHP-VE---NFQLQNDQLYLYLYLQNGKDMYTGEEL--S--ISNLSHYDIDHI | 842 |
| WP_049531101 | 777 | QQRYKRIEDSLK ILAS NILKEHP-TD---NNQLQNDRLYLYLQNGKDMYTGNPL--D--INHLSSYDIDHI | 844 |
| WP_049538452 | 777 | QQRYKRIENSLK ILAS NILKEHP-TD---NIQLQNDRLYLYLQNGKDMYTGEAL--D--INQLSSCDIDHI | 844 |
| WP_049549711 | 777 | QQRYKRIEDALK NLAP NILKEHP-TD---NNQLQNDRLYLYLQNGKDMYTGEAL--D--INQLSSYDIDHI | 844 |
| WP_007896501 | 781 | RQRLKKIKEVHK KTGS RILEDNserIT--NLTLQDNRLYLYLLQDGKDMYTGQDL--D--INNLSQYDIDHI | 846 |
| EFR44625 | 733 | RQRLKKIKEVHK KTGS RILEDNserIT--NLTLQDNRLYLYLLQDGKDMYTGQDL--D--INNLSQYDIDHI | 798 |
| WP_002974477 | 776 | QQRYKRIEDALK NLAP NILKEHP-TD---NIQLKNDRLYLYLQNGKDMYTGKPL--D--INQLSSYDIDHI | 843 |
| WP_002906454 | 777 | QQRYKRIEDALK NLAP NILKEHP-TN---NIQLQNDRLYLYLQNGKDMYTGKAI--D--INQLSNYDIDHI | 844 |
| WP_009729476 | 780 | QQRYKRIEDSLK ILAS KILKEHP-TD---NIQLQNDRLYLYLQNGKDMYTGDTL--D--INQLSSCDIDHI | 843 |
| CQR24647 | 776 | QQRIGSLITKAIQ DFGS DILKRYP-VE---NNQLQNDQLYLYLYLQNGKDMYTGKPL--E--IHNLSQYDIDHI | 846 |
| WP_000066813 | 779 | QQRYKRIEDSLK NILAS NILKEHP-TD---NIQLQNDRLYLYLQNGKDMYTGKPL--D--INQLSNYDIDHI | 846 |
| WP_009754323 | 777 | QQRYKRIEDALK NLAP TISKENP-TD---NNQLQNDRLYLYLQNGKDMYTGEAL--D--INQLSSYDIDHI | 844 |
| WP_044674937 | 776 | QQRYKKIENAIK NLNS KILKEYP-TN---NQALQNDRLFLYYLQNGKDMYTDEEL--D--IDQLSQYDIDHI | 843 |
| WP_044676715 | 778 | QQRYKKIENAIK NLNS KILKEYP-TN---NQALQNDRLFLYYLQNGKDMYTDEEL--D--IDQLSQYDIDHI | 845 |
| WP_044680361 | 778 | QQRYKKIENAIK NLNS KILKEYP-TN---NQALQNDRLFLYYLQNGKDMYTDEEL--D--IDQLSQYDIDHI | 845 |

-continued

| | | | | |
|---|---|---|---|---|
| WP_044681799 | 776 | QQRYKKIENAIK NLNS KILKEYP- TN- --NQALQNDRLFLYYLQNGKDMYTDEEL- -D- --IDQLSQYDIDHI | 843 |
| WP_049533112 | 778 | QQRLKLLQDSLK PVNI K----- -N- -VE- --NQQLQNDRLFLYYLQNGKDMYTGETL- -D- --INNLSQYDIDHI | 840 |
| WP_029090905 | 753 | TPRDKFIEKAYA ETDT EHLKELK-- -Qr- -SKQLSSQRLFLYFIQNGKCMYSGEHL- -D- --IERLDSYEVDHI | 823 |
| WP_006506696 | 777 | ESKIKKLENVYK DEQT SVLEELKg- -FDn- -TKKISSDSLFLYFTQLGKCMYSGKKL- -D- --IDSLDKYQIDHI | 849 |
| AIT42264 | 778 | RERMKRIEEGIK ELGS QILKEHP- -VE- --NTQLQNEKLYLYLQNGRDMYVDQEL- -D- --INRLSDYDVDHI | 841 |
| WP_034440723 | 785 | KARLKKQEGLE NLDS HVEKQAL- -D- --EEMLKSPKYYLYCLQNGKDIYTGKDL- -D- --IGQLQTYDIDHI | 848 |
| AKQ21048 | 778 | RERMKRIEEGIK ELGS QILKEHP- -VE- --NTQLQNEKLYLYLQNGRDMYVDQEL- -D- --INRLSDYDVDHI | 841 |
| WP_004636532 | 781 | KERIEKLTEAIK EFDG --VKVKD- -LK- -NENLRNDRLYLYYLQNGRDMYTNEPL- -D- --INNLSKYDIDHI | 845 |
| WP_002364836 | 789 | IQRLKIVEKAMA EIGS NLLKEQP- -TT- --NEQLRDTRLFLYYMQNGKDMYTGDEL- -S- --LHRLSHYDIDHI | 852 |
| WP_016631044 | 740 | IQRLKIVEKAMA EIGS NLLKEQP- -TT- --NEQLRDTRLFLYYMQNGKDMYTGDEL- -S- --LHRLSHYDIDHI | 803 |
| EMS75795 | 525 | KPRLKALEEALK SFDS PLLKEQP- -VD- --NQALQDRLYLYLYLQNGKDMYTGEAL- -D- --IDRLSEYDIDHI | 588 |
| WP_002373311 | 789 | IQRLKIVEKAMA EIGS NLLKEQP- -TT- --NEQLRDTRLFLYYMQNGKDMYTGDEL- -S- --LHRLSHYDIDHI | 852 |
| WP_002378009 | 789 | IQRLKIVEKAMA EIGS NLLKEQP- -TT- --NEQLRDTRLFLYYMQNGKDMYTGDEL- -S- --LHRLSHYDIDHI | 852 |
| WP_002407324 | 789 | IQRLKIVEKAMA EIGS NLLKEQP- -TT- --NEQLRDTRLFLYYMQNGKDMYTGDEL- -S- --LHRLSHYDIDHI | 852 |
| WP_002413717 | 789 | IQRLKIVEKAMA EIGS NLLKEQP- -TT- --NEQLRDTRLFLYYMQNGKDMYTGDEL- -S- --LHRLSHYDIDHI | 852 |
| WP_010775580 | 791 | IQRLKIVEKAMA EIGS NLLKEQP- -TT- --NEQLRDTRLFLYYMQNGKDMYTGDEL- -S- --LHRLSHYDIDHI | 854 |
| WP_010818269 | 789 | IQRLKIVEKAMA EIGS NLLKEQP- -TT- --NEQLRDTRLFLYYMQNGKDMYTGDEL- -S- --LHRLSHYDIDHI | 852 |
| WP_010824395 | 789 | IQRLKIVEKAMA EIGS NLLKEQP- -TT- --NEQLRDTRLFLYYMQNGKDMYTGDEL- -S- --LHRLSHYDIDHI | 852 |
| WP_016622645 | 789 | IQRLKIVEKAMA EIGS NLLKEQP- -TT- --NEQLRDTRLFLYYMQNGKDMYTGDEL- -S- --LHRLSHYDIDHI | 852 |
| WP_033624816 | 789 | IQRLKIVEKAMA EIGS NLLKEQP- -TT- --NEQLRDTRLFLYYMQNGKDMYTGDEL- -S- --LHRLSHYDIDHI | 852 |
| WP_033625576 | 789 | IQRLKIVEKAMA EIGS NLLKEQP- -TT- --NEQLRDTRLFLYYMQNGKDMYTGDEL- -S- --LHRLSHYDIDHI | 852 |
| WP_033789179 | 789 | IQRLKIVEKAMA EIGS NLLKEQP- -TT- --NEQLRDTRLFLYYMQNGKDMYTGDEL- -S- --IHRLSHYDIDHI | 852 |
| WP_002310644 | 790 | RPRLKALEESLK DFGS QLLKEYP- -TD- --NSSLQKDRLYLYLYLQNGRDMYTGAPL- -D- --IHRLSDYDIDHI | 853 |
| WP_002312694 | 790 | RPRLKALEESLK DFGS QLLKEYP- -TD- --NSSLQKDRLYLYLYLQNGRDMYTGAPL- -D- --IHRLSDYDIDHI | 853 |
| WP_002314015 | 790 | RPRLKALEESLK DFGS QLLKEYP- -TD- --NSSLQKDRLYLYLYLQNGRDMYTGAPL- -D- --IHRLSDYDIDHI | 853 |
| WP_002320716 | 790 | RPRLKALEESLK DFGS QLLKEYP- -TD- --NSSLQKDRLYLYLYLQNGRDMYTGAPL- -D- --IHRLSDYDIDHI | 853 |
| WP_002330729 | 789 | RPRLKALEESLK DFGS QLLKEYP- -TD- --NSSLQKDRLYLYLYLQNGRDMYTGAPL- -D- --IHRLSDYDIDHI | 852 |
| WP_002335161 | 790 | RPRLKALEESLK DFGS QLLKEYP- -TD- --NSSLQKDRLYLYLYLQNGRDMYTGAPL- -D- --IHRLSDYDIDHI | 853 |
| WP_002345439 | 790 | RPRLKALEESLK DFGS QLLKEYP- -TD- --NSSLQKDRLYLYLYLQNGRDMYTGAPL- -D- --IHRLSDYDIDHI | 853 |
| WP_034867970 | 781 | SPRLKALENGLK QIGS TLLKEQP- -TD- --NKALQKERLYLYLYLQNGRDMYTGEPL- -E- --IENLHQYEVDHI | 844 |
| WP_047937432 | 790 | KPRLKALEESLK DFGS QLLKEYP- -TD- --NSSLQKDRLYLYLYLQNGRDMYTGAPL- -D- --IHRLSDYDIDHI | 853 |
| WP_010720994 | 781 | KPRLKALENGLK QIGS TLLKEQP- -TD- --NKALQKERLYLYLYLQNGRDMYTGEPL- -E- --IENLHQYEVDHI | 844 |
| WP_010737004 | 781 | SPRLKALENGLK QIGS TLLKEQP- -TD- --NKALQKERLYLYLYLQNGRDMYTGEPL- -E- --IENLHQYEVDHI | 844 |
| WP_034700478 | 781 | KPRLKALENGLK QIGS TLLKEQP- -TD- --NKALQKERLYLYLYLQNGRDMYTGEPL- -E- --IENLHQYEVDHI | 844 |
| WP_007209003 | 782 | KPRLKGIENGLK EFSD SVLKGSS- -ID- --NKQLQNDRLYLYLYLQNGKDMYTGHEL- -D- --IDHLSTYDIDHI | 845 |
| WP_023519017 | 775 | RPRLKALEEALK NIDS PLLKDYP- -TD- --NQALQDRLYLYFLQNGKSLYSEESL- -E- --INKLSDYQVDHI | 838 |
| WP_010770040 | 782 | NPRMKALEEAMR NLRS NLLKEYP- -TD- --NQALQNDRLYLYLYLQNGKDMYTGLDL- -S- --LHNLSSYDIDHI | 845 |
| WP_048604708 | 779 | RPRLKNLEKAID DLDS EILKKHP- -VD- --NKALQNDRLYLYLYLQNGKDMYTNEEL- -D- --IHKLSTYDIDHI | 842 |
| WP_010750235 | 784 | KPRLKSLEEALK NFDS QLLKERP- -VD- --NQSLQKDRLYLYYLQNGKDMYTGESL- -D- --IDRLSEYDIDHI | 847 |
| AII16583 | 817 | RERMKRIEEGIK ELGS QILKEHP- -VE- --NTQLQNEKLYLYLQNGRDMYVDQEL- -D- --INRLSDYDVDHI | 880 |
| WP_029073316 | 789 | DSFVNQMLKLYK DFED EANKHLKg- -EDa- -KSKIRSERLKLYYTQMGKCMYGKSL- -D- --IDRLDTYQVDHI | 860 |
| WP_031589969 | 789 | DSFVNQMLKLYK DFED EANKHLKg- -EDa- -KSKIRSERLKLYYTQMGKCMYTGKSL- -D- --IDRLDTYQVDHI | 860 |
| KDA45870 | 772 | EDRVQQIVKNLK ELPK ------ -P- --S- --NAELSDERKYLYCLQNGRDMYTGAPL- -D- --YDHLQFYDVDHI | 833 |
| WP_039099354 | 789 | KRQVEQVYQNIS EL-- EIRNELK- --D- --EIRNELK---D- --LSSERIMYFLQNGKSLYSEESL- -N- --INKLSDYQVDHI | 856 |
| AKP02966 | 786 | RLQSKLLNKANG -LVP EELKKHKn- -D- --LSSERIMYFLQNGKSLYSEESL- -N- --INKLSDYQVDHI | 858 |
| WP_010991369 | 781 | RPRYKSLEKAIK EFGS QILKEHP- -TD- --NQELRNNRLYLYLYLQNGKDMYTGQDL- -D- --IHNLSNYDIDHI | 844 |
| WP_033838504 | 781 | RPRYKSLEKAIK EFGS QILKEHP- -TD- --NQELRNNRLYLYLYLQNGKDMYTGQDL- -D- --IHNLSNYDIDHI | 844 |
| EHN60060 | 784 | RPRLKNLEKAIK EFGS QILKEHP- -VD- --NQELRNNRLYLYLYLQNGKDMYTGQDL- -D- --IHNLSNYDIDHI | 847 |
| EFR89594 | 550 | RPRYKSLEKAIK EFGS QILKEHP- -TD- --NQELRNNRLYLYLYLQNGKDMYTGQDL- -D- --IHNLSNYDIDHI | 613 |
| WP_038409211 | 781 | KPRFISLEKAIK EFGS QILKEHP- -TD- --NQCLKNDRLYLYLYLQNGKDMYTGKEL- -D- --IHNLSNYDIDHI | 844 |
| EFR95520 | 400 | KPRFISLEKAIK EFGS QILKEHP- -TD- --NQCLKNDRLYLYLYLQNGKDMYTGKEL- -D- --IHNLSNYDIDHI | 463 |
| WP_003723650 | 781 | KPRYKSLEKAIK EFGS QILKEHP- -TD- --NQELKNNRLYLYLYLQNGKDMYTGQEL- -D- --IHNLSNYDIDHI | 844 |
| WP_003727705 | 781 | KPRYKSLEKAIK DFGS QILKEHP- -TD- --NQELKNNRLYLYLYLQNGKDIYTGQEL- -D- --IHNLSNYDIDHI | 844 |

-continued

| | | | | |
|---|---|---|---|---|
| WP_003730785 | 781 | KPRYKSLEKAIK DFGS QILKEHP--TD---NQELKNNRLYLYYLQNGKDMYTGQEL--IHNLSNYDIDHI | 844 |
| WP_003733029 | 781 | KPRYKSLEKAIK EFGS QILKEHP--TD---NQELKNNRLYLYYLQNGKDMYTGQEL--IHNLSNYDIDHI | 844 |
| WP_003739838 | 781 | RPRYKSLEKAIK EFGS QILKEHP--TD---NQELRNNRLYLYYLQNGKDMYTGQEL--IHNLSNYDIDHI | 844 |
| WP_014601172 | 781 | KPRYKSLEKAIK EFGS KILKEHP--TD---NQELKNNRLYLYYLQNGKDMYTGQEL--IHNLSNYDIDHI | 844 |
| WP_023548323 | 781 | KPRYKSLEKAIK EFGS QILKEHP--TD---NQELKNNRLYLYYLQNGKDMYTGQEL--IHNLSNYDIDHI | 844 |
| WP_031665337 | 781 | KPRYKSLEKAIK EFGS QILKEHP--TD---NQELKNNRLYLYYLQNGKDMYTGQEL--IHNLSNYDIDHI | 844 |
| WP_031669209 | 781 | KPRYKSLEKAIK EFGS QILKEHP--TD---NQELKNNRLYLYYLQNGKDMYTGQEL--IHNLSNYDIDHI | 844 |
| WP_033920898 | 781 | KPRYKSLEKAIK EFGS QILKEHP--TD---NQELKNNRLYLYYLQNGKDMYTGQEL--IHNLSNYDIDHI | 844 |
| AKI42028 | 784 | KPRYKSLEKAIK EFGS QILKEHP--TD---NQELKNNRLYLYYLQNGKDMYTGQEL--IHNLSNYDIDHI | 847 |
| AKI50529 | 784 | KPRYKSLEKAIK EFGS KILKEHP--TD---NQELKNNRLYLYYLQNGKDMYTGQEL--IHNLSNYDIDHI | 847 |
| EFR83390 | 229 | RPRYKSLEKAIK EFGS QILKEHP--TD---NQELKNNRLYLYYLQNGKDMYTGQEL--IHNLSNYDIDHI | 292 |
| WP_046323366 | 781 | KPRFTSLEKAIK ELGS QILKEHP--TD---NQGLKNDRLYLYYLQNGKDMYTGQEL--IHNLSNYDIDHV | 844 |
| AKE81011 | 794 | RERMKRIEEGIK ELGS QILKEHP--VE---NTQLQNEKLYLYYLQNGRDMYVDQEL--INRLSDYDVDHI | 857 |
| CUO82355 | 781 | ESKIKKLENVYK DEQT SVLEELKg-FDn-TKKISSDSLPLYFTQLGKCMYSGKKL--IDSLDKYQIDHI | 853 |
| AKB162887 | 784 | ESKIAKLQKIYE NLQT QVYESLKr-EDa-KKRMETDALYLYLQMGKSMYSGKPL--IDKLSTYQIDHI | 855 |
| AGZ01981 | 811 | RERMKRIEEGIK ELGS QILKEHP--VE---NTQLQNEKLYLYYLQNGRDMYVDQEL--INRLSDYDVDHI | 874 |
| AKA60242 | 778 | RERMKRIEEGIK ELGS QILKEHP--VE---NTQLQNEKLYLYYLQNGRDMYVDQEL--INRLSDYDVDAI | 841 |
| AKS40380 | 778 | RERMKRIEEGIK ELGS QILKEHP--VE---NTQLQNEKLYLYYLQNGRDMYVDQEL--INRLSDYDVDHI | 841 |
| 4UN5_B | 782 | RERMKRIEEGIK ELGS QILKEHP--VE---NTQLQNEKLYLYYLQNGRDMYVDQEL--INRLSDYDVDAI | 845 |
| WP_010922251 | 842 | VPQSFLKDDSIDNKVLTRSDKNRG-KSDN--VP S--EEVVKKMKN-YWRQLLNAKLITQRKEDNLTKA--ERGGLSE | 910 |
| WP_039995303 | 852 | IPQAFIKDDSIDNRVLTSSKDNRG-KSDN--VP S--LDIVRARKA-EMVRLYKSGLISKRKFDNLTKA--ERGGLTE | 920 |
| WP_045635197 | 844 | IPQAFIKDDSLDNRVLTSSKDNRG-KSDN--VP S--IEVVQKRKA-FWQQLLDSKLISERKFPNNLTKA--ERGGLDE | 912 |
| 5AXW_A | 562 | IPRSVSFDNSFNNKVLVKQEEASK-KGMR--TP Fgy-LSSSDSKI-SYETFKKHILNLAKGKGRISKTk--KEYLEE | 632 |
| WP_009880683 | 526 | VPQSFIKDDSIDNKVLTRSDKNRG-KSDN--VP S--EEVVKKMKN-YWKQLLNAKLITQRKFPDNLTKA--ERGGLSE | 594 |
| WP_010922251 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_011054416 | 842 | VPQSFLKDDSIDNKVLTRSDKNRG-KSDN--VP S--EEVVKKMKN-YWKQLLNAKLITQRKFPDNLTKA--ERGGLSE | 910 |
| WP_011284745 | 842 | VPQSFIKDDSIDNKVLTRSDKNRG-KSNN--VP S--EEVVKKMKN-YWKQLLNAKLITQRKFPDNLTKA--ERGGLSE | 910 |
| WP_011285506 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_011527619 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_012560673 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_014407541 | 841 | VPQSFIKDDSIDNKVLTRSDKNRG-KSDN--VP S--EEVVKKMKN-YWKQLLNAKLITQRKFPDNLTKA--ERGGLSE | 909 |
| WP_020905136 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_023080005 | 841 | VPQSFIKDDSIDNKVLTRSDKNRG-KSDN--VP S--EEVVKKMKN-YWKQLLNAKLITQRKFPDNLTKA--ERGGLSE | 909 |
| WP_023610282 | 841 | VPQSFIKDDSIDNKVLTRSDKNRG-KSDN--VP S--EEVVKKMKN-YWKQLLNAKLITQRKFPDNLTKA--ERGGLSE | 909 |
| WP_030125963 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_030126706 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_031488318 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_032460140 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_032461047 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_032462016 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_032462936 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_032464890 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_033888930 | 667 | VPQSFIKDDSIDNKVLTRSDKNRG-KSDN--VP S--EEVVKKMKN-YWKQLLNAKLITQRKFPDNLTKA--ERGGLSE | 735 |
| WP_038431314 | 842 | VPQSFIKDDSIDNKVLTRSDKNRG-KSDN--VP S--EEVVKKMKN-YWKQLLNAKLITQRKFPDNLTKA--ERGGLSE | 910 |
| WP_038432938 | 841 | VPQSFIKDDSIDNKVLTRSDKNRG-KSDN--VP S--EEVVKKMKN-YWKQLLNAKLITQRKFPDNLTKA--ERGGLSE | 909 |
| WP_038434062 | 842 | VPQSFIKDDSIDNKVLTRSDKNRG-KSDN--VP S--EEVVKKMKN-YWKQLLNAKLITQRKFPDNLTKA--ERGGLSE | 910 |
| BAQ51233 | 753 | VPQSFLKDDSIDNKVLTRSDKNRG-KSDN--VP S--EEVVKKMKN-YWKQLLNAKLITQRKFPDNLTKA--ERGGLSE | 821 |
| KGE60162 | 17 | | 85 |
| KGE60856 | | | |
| WP_002989955 | 842 | VPQSFLKDDSIDNKVLTRSDKNRG-KSDN--VP S--EEVVKKMKN-YWRQLLNAKLITQRKFDNLTKA--ERGGLSE | 910 |
| WP_003030002 | 841 | IPQAFIKDNSLDNRVLTRSDKNRG-KSDD--VP S--IEVVHEMKS-FWSKLLSVKLITQRKFPDNLTKA--ERGGLSE | 909 |
| WP_003065552 | 852 | IPQAFIKDDSIDNRVLTSSAKNRG-KSDD--VP S--LDIVRARKA-EMVRLYKSGLISKRKFPDNLTKA--ERGGLTE | 920 |
| WP_001040076 | 847 | IPQAFIKDDSIDNRVLVSSAKNRG-KSDD--VP S--LEIVDCKV-FWKKLLDAKLMSQRKYDNLTKA--ERGGLTS | 915 |

-continued

```
WP_001040078    847  IPQAFIKDDSIDNRVLVSSAKNRG-KSDD--VP S--LEIVKDCKV-FWKKLLDAKLMSQRKYDNLTKA--ERGGLTS  915
WP_001040080    847  IPQAFIKDDSIDNRVLVSSAKNRG-KSDD--VP S--LEIVKDCKV-FWKKLLDAKLMSQRKYDNLTKA--ERGGLTS  915
WP_001040081    847  IPQAFIKDDSIDNRVLVSSAKNRG-KSDD--VP S--LEIVKDCKV-FWKKLLDAKLMSQRKYDNLTKA--ERGGLTS  915
WP_001040083    847  IPQAFIKDDSIDNRVLVSSAKNRG-KSDD--VP S--LEIVKDCKV-FWKKLLDAKLMSQRKYDNLTKA--ERGGLTS  915
WP_001040085    847  IPQAFIKDDSIDNRVLVSSAKNRG-KSDD--VP S--LEIVKDCKV-FWKKLLDAKLMSQRKYDNLTKA--ERGGLTS  915
WP_001040087    847  IPQAFIKDDSIDNRVLVSSAKNRG-KSDD--VP S--LEIVKDCKV-FWKKLLDAKLMSQRKYDNLTKA--ERGGLTS  915
WP_001040088    847  IPQAFIKDDSIDNRVLVSSAKNRG-KSDD--VP S--LEIVKDCKV-FWKKLLDAKLMSQRKYDNLTKA--ERGGLTS  915
WP_001040089    847  IPQAFIKDDSIDNRVLVSSAKNRG-KSDD--VP S--LEIVKDCKV-FWKKLLDAKLMSQRKYDNLTKA--ERGGLTS  915
WP_001040090    847  IPQAFIKDDSIDNRVLVSSAKNRG-KSDD--VP S--LEIVKDCKV-FWKKLLDAKLMSQRKYDNLTKA--ERGGLTS  915
WP_001040091    847  IPQAFIKDDSIDNRVLVSSAKNRG-KSDD--VP S--LEIVKDCKV-FWKKLLDAKLISQRKYDNLTKA--ERGGLTS  915
WP_001040092    847  VPQAFIKDDSIDNRVLVSSAKNRG-KSDD--VP S--LEIVKDCKV-FWKKLLDAKLMSQRKYDNLTKA--ERGGLTS  915
WP_001040094    847  IPQAFIKDDSIDNRVLVSSAKNRG-KSDD--VP S--LEIVKDCKV-FWKKLLDAKLMSQRKYDNLTKA--ERGGLTP  915
WP_001040095    847  IPQAFIKDDSIDNRVLVSSAKNRG-KSDD--VP S--VEIVKDCKV-FWKKLLDAKLMSQRKYDNLTKA--ERGGLTS  915
WP_001040096    847  IPQAFIKDDSIDNRVLVSSAKNRG-KSDD--VP S--LEIVKDCKV-FWKKLLDAKLMSQRKYDNLTKA--ERGGLTS  915
WP_001040097    847  IPQAFIKDDSIDNRVLVSSAKNRG-KSDD--VP S--VEIVKDCKV-FWKKLLDAKLMSQRKYDNLTKA--ERGGLTS  915
WP_001040098    847  IPQAFIKDDSIDNRVLVSSAKNRG-KSDD--VP S--LEIVKDCKV-FWKKLLDAKLMSQRKYDNLTKA--ERGGLTS  915
WP_001040099    847  VPQAFIKDDSIDNRVLVSSAKNRG-KSDD--VP S--VEIVKDCKV-FWKKLLDAKLMSQRKYDNLTKA--ERGGLTS  915
WP_001040100    847  VPQAFIKDDSIDNRVLVSSAKNRG-KSDD--VP S--VEIVKDCKV-FWKKLLDAKLMSQRKYDNLTKA--ERGGLTS  915
WP_001040104    847  IPQAFIKDDSIDNRVLVSSAKNRG-KSDD--VP S--LEIVKDCKV-FWKKLLDAKLMSQRKYDNLTKA--ERGGLTS  915
WP_001040105    847  IPQAFIKDDSIDNRVLVSSAKNRG-KSDD--VP S--LEIVKDCKV-FWKKLLDAKLMSQRKYDNLTKA--ERGGLTS  915
WP_001040106    847  VPQAFIKDDSIDNRVLVSSAKNRG-KSDN--VP S--IDIVKARKA-FWKKLLDAKLMSQRKYDNLTKA--ERGGLTS  915
WP_001040107    847  IPQAFIKDDSIDNRVLVSSAKNRG-KSDN--VP S--IDIVKARKA-FWKKLLDAKLMSQRKYDNLTKA--ERGGLTS  915
WP_001040108    847  IPQAFIKDDSIDNRVLVSSAKNRG-KSDN--VP S--IDIVKARKA-FWKKLLDAKLMSQRKYDNLTKA--ERGGLTS  915
WP_001040109    847  IPQAFIKDDSIDNRVLVSSAKNRG-KSDN--VP S--IDIVKARKA-FWKKLLDAKLMSQRKYDNLTKA--ERGGLTS  915
WP_001040110    847  VPQAFIKDDSIDNRVLVSSAKNRG-KSDN--VP S--IDIVKARKA-FWKKLLDAKLMSQRKYDNLTKA--ERGGLTS  915
WP_015058523    847  IPQAFIKDDSIDNRVLVSSAKNRG-KSDN--VP S--LEIVKDCKV-FWKKLLDAKLISQRKYDNLTKA--ERGGLTP  915
WP_017643650    847  IPQAFIKDDSIDNRVLVSSAKNRG-KSDD--VP S--VEIVKDCKV-FWKKLLDAKLMSQRKYDNLTKA--ERGGLTS  915
WP_017647151    847  IPQAFIKDDSIDNRVLVSSAKNRG-KSDD--VP S--IDIVKARKA-FWKKLLDAKLMSQRKYDNLTKA--ERGGLTS  915
WP_017648376    847  IPQAFIKDDSIDNRVLVSSAKNRG-KSDD--VP S--IDIVKARKA-FWKKLLDAKLMSQRKYDNLTKA--ERGGLTS  915
WP_017649527    847  IPQAFIKDDSIDNRVLVSSAKNRG-KSDN--VP S--IDIVKARKA-FWKKLLDAKLMSQRKYDNLTKA--ERGGLTS  915
WP_017771611    847  IPQAFIKDDSIDNRVLVSSAKNRG-KSDD--VP S--LEIVKDCKV-FWKKLLDAKLMSQRKYDNLTKA--ERGGLTS  915
WP_017771984    847  IPQAFIKDDSIDNRVLVSSAKNRG-KSDD--VP S--LEIVKDCKV-FWKKLLDAKLMSQRKYDNLTKA--ERGGLTS  915
CFQ25032        847  IPQAFIKDDSIDNRVLVSSAKNRG-KSDD--VP S--LEIVKDCKV-FWKKLLDAKLMSQRKYDNLTKA--ERGGLTS  915
CFV16040        847  IPQAFIKDDSIDNRVLVSSAKNRG-KSDD--VP S--LEIVKDCKV-FWKKLLDAKLMSQRKYDNLTKA--ERGGLTS  915
KLJ37842        847  IPQAFIKDDSIDNRVLVSSAKNRG-KSDD--VP S--LEIVKDCKV-FWKKLLDAKLMSQRKYDNLTKA--ERGGLTS  915
KLJ72361        861  IPQAFIKDDSIDNRVLVSSEENRG-KSDN--VP S--LEIVKDCKV-DWMRLRKAGLISQRKFDNLTKA--ERGGLTS  929
KLL20707        847  IPQAFIKDDSIDNRVLVSSAKNRG-KSDD--VP S--IDIVKARKA-FWKKLLDAKLMSQRKYDNLTKA--ERGGLTS  915
KLL42645        847  VPQAFIKDDSIDNRVLVSSAKNRG-KSDD--VP S--LEIVKDCKV-FWKKLLDAKLMSQRKYDNLTKA--ERGGLTS  915
WP_047207273    847  IPQAFIKDDSIDNRVLVSSAKNRG-KSDD--VP S--LEIVKDCKV-FWKKLLDAKLMSQRKYDNLTKA--ERGGLTS  915
WP_047209694    847  IPQAFIKDDSIDNRVLVSSAKNRG-KSDD--VP S--VEIVKDCKV-FWKKLLDAKLMSQRKYDNLTKA--ERGGLTS  915
WP_050198062    847  IPQAFIKDDSIDNRVLTRSDKNRG-KSDD--VP S--LEIVKDCKV-FWKKLLDAKLMSQRKYDNLTKA--ERGGLTS  915
WP_050201642    847  IPQAFIKDDSIDNRVLTRSDKNRG-KSDD--VP S--LEIVKDCKV-FWKKLLDAKLMSQRKYDNLTKA--ERGGLTS  915
WP_050204027    847  VPQAFIKDDSIDNRVLTRSDKNRG-KSDD--VP S--LEIVKDCKV-FWKKLLDAKLMSQRKYDNLTKA--ERGGLTS  915
WP_050881965    847  IPQAFIKDDSIDNRVLVSSAKNRG-KSDD--VP S--LEIVKDCKV-FWKKLLDAKLMSQRKYDNLTKA--ERGGLTS  915
WP_050886065    847  IPQAFIKDDSIDNRVLVSSAKNRG-KSDD--VP S--IDIVKARKA-FWKKLLDAKLMSQRKYDNLTKA--ERGGLTS  915
AHN30376        847  IPQAFIKDDSIDNRVLVSSAKNRG-KSDD--VP S--LEIVKDCKV-FWKKLLDAKLMSQRKYDNLTKA--ERGGLTP  915
EA078426        847  IPQAFIKDDSIDNRVLVSSAKNRG-KSDD--VP S--LEIVKDCKV-FWKKLLDAKLMSQRKYDNLTKA--ERGGLTS  915
CCW42055        847  IPQAFIKDDSIDNRVLVSSAKNRG-KSDD--VP S--LEIVKDCKV-FWKKLLDAKLMSQRKYDNLTKA--ERGGLTS  915
WP_003041502    841  IPQAYIKDDSFDNRVLTSSENRG-KSDN--VP S--IEVVCARKA-DWMRLRKAGLISQRKFDNLTKA--ERGGLTE  909
WP_037593752    842  IPQAFIKDNSLDNRVLTRSDKNRG-KSDD--VP S--IEVVHEMKS-FWSKLLSVKLITQRKFDNLTKA--ERGGLTE  910
WP_049516684    842  IPQAFIKDNSLDNRVLTRSDKNRG-KSDD--VP S--IEVVHEMKS-FWSKLLSVKLITQRKFDNLTKA--ERGGLTE  910
GAD46167        841  IPQAFIKDNSLDNRVLTRSDKNRG-KSDD--VP S--IEVVHEMKS-FWSKLLSVKLITQRKFDNLTKA--ERGGLTE  909
WP_018363470    850  IPQAFIKDDSIDNRVLTSSAKNRG-KSDD--VP S--LGIVRARKA-EWVRLYKSGLISKRKFDNLTKA--ERGGLTE  918
```

-continued

| | | | | |
|---|---|---|---|---|
| WP_003043819 | 851 | VPQSFIKDDSIDNKVLTRSVENRG-KSDN--VP | S--EEVVKKMKN-YWRQLLNAKLITQRKFPDNLTKA--ERGGLSE | 919 |
| WP_006269658 | 841 | IPQAFIKDDSIDNSLDNRVLTRSDKNRG-KSDD--VP | S--IEVVHEMKS-FWSKLLSVKLITQRKFPDNLTKA--ERGGLTE | 909 |
| WP_048800089 | 841 | IPQAFIKDDSIDNRVLTSSAKNRG-KSDN--VP | N--LEVVCDRKA-DWIRLREAGLISQRKFPDNLTKA--ERGGLTE | 909 |
| WP_012767106 | 841 | VPQSFIKDDSIDNKILTRSDKNRG-KSDN--VP | S--EEVVKKMKN-YWRQLLNAKLITQRKFPDNLTKA--ERGGLSE | 909 |
| WP_014612333 | 841 | VPQSFIKDDSIDNKVLTRSDKNRG-KSDD--VP | S--EEVVKKMKN-YWRQLLNAKLITQRKFPDNLTKA--ERGGLSE | 909 |
| WP_015017095 | 841 | VPQSFIKDDSIDNKVLTRSDKNRG-KSDD--VP | S--EEVVKKMKN-YWRQLLNAKLITQRKFPDNLTKA--ERGGLSE | 909 |
| WP_015057649 | 841 | VPQSFIKDDSIDNKVLTRSDKNRG-KSDD--VP | S--EEVVKKMKN-YWRQLLNAKLITQRKFPDNLTKA--ERGGLSE | 909 |
| WP_048327215 | 841 | VPQSFIKDDSIDNKVLTRSDKNRG-KSDD--VP | S--EEVVKKMKN-YWRQLLNAKLITQRKFPDNLTKA--ERGGLSE | 909 |
| WP_049519324 | 841 | IPQSFIKNNSIDNKVLTSQGANRG-KLDN--VP | S--EAIVRKMKG-YWQSLLRAGAISKQKFPDNLTKA--ERGGLTQ | 909 |
| WP_012515931 | 841 | IPQSFIKNNSIDNKVLTSQGANRG-KLDN--VP | S--EAIVRKMKG-YWQSLLRAGAISKQKFPDNLTKA--ERGGLTQ | 909 |
| WP_021320964 | 841 | IPQSFIKNNSIDNKVLTSQGANRG-KLDN--VP | S--EAIVRMKG-YWQSLLRAGAISKQKFPDNLTKA--ERGGLTQ | 909 |
| WP_037581760 | 841 | IPQSFIKNNSIDNKVLTSSAKNRG-KSDD--VP | S--IEIVRNRKS-YWYKLYKSGLISKRKFPDNLTKA--ERGGLTE | 917 |
| WP_004232481 | 849 | IPQAFIKDDSIDNRVLTSSAKNRG-KSDD--VP | S--LDIVRARKA-EWVRLYKSGLISKRKFPDNLTKA--ERGGLTE | 918 |
| WP_009854540 | 850 | IPQAFIKDDSIDNRVLTSSAKNRG-KSDD--VP | S--LDIVHDRKA-DWIRLYKSGLISKRKFPDNLTKA--ERGGLTE | 918 |
| WP_012962174 | 850 | IPQAFIKDDSIDNRVLTSSAKNRG-KSDD--VP | S--LDIVRARKA-EWVRLYKSGLISKRKFPDNLTKA--ERGGLTE | 920 |
| WP_039695303 | 852 | IPQAFIKDNSIDNRVLTSSAKNRG-KSDD--VP | S--IEIVRNRRS-YWYKLYKSGLISKRKFPDNLTKA--ERGGLTE | 917 |
| WP_014334983 | 849 | IPQSFIKDNSIDNTVLITQASNRG-KSDN--VP | N--IETVNKMKS-FWYKQLKSGAISQRKFPDHLTKA--ERGALSD | 910 |
| WP_003099269 | 842 | IPQSFIKDNSIDNTVLITQASNRG-KSDN--VP | N--IETVNKMKS-FWYKQLKSGAISQRKFPDHLTKA--ERGALSD | 910 |
| AHY15608 | 842 | IPQSFIKDNSIDNTVLITQASNRG-KSDN--VP | N--IETVNKMKS-FWYKQLKSGAISQRKFPDHLTKA--ERGALSD | 910 |
| AHY17476 | | ------------------------------------ | ------------------------------------------- | |
| ESR09100 | | ------------------------------------ | ------------------------------------------- | |
| AGM98575 | 842 | IPQAFIKDNSIDNRVLTSSKENRG-KSDN--VP | N--IETVNKMKS-FWYKRMKS-YWSKLLSAKLITQRKFPDNLTKA--ERGALSD | 910 |
| ALF27331 | 858 | VPRSYIKNDSFDNKVLTSKGNRK-KLDD--VP | A--KEVVEKMEN-TWRRLHAAGLISDIKLSYLMKGe----LTE | 923 |
| WP_018372492 | 845 | VPRSYIKNDSFDNKVLTSKGNRK-KLDD--VP | S--LEIIVQKRKA-FWQQLLDSKLISERKFNNLTKA--ERGGLDE | 913 |
| WP_045618028 | 844 | IPQAFIKDDSLDNRVLTSSKDNRG-KSDN--VP | S--IEVVQKRKA-FWQQLLDSKLISERKFNNLTKA--ERGGLDE | 912 |
| WP_045635197 | 842 | IPQAFIKDNSIDNRVLTSSKENRG-KSDN--VP | S--KDVVRKMKS-YWSKLLSAKLITQRKFPDNLTKA--ERGGLTD | 910 |
| WP_002263549 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_002263887 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_002264920 | 842 | IPQAFIKDNSIDNRVLTSSKENRG-KSDD--VP | S--KDVVRKMKS-YWSKLLSAKLITQRKFPDNLTKG--ERGGLTD | 910 |
| WP_002269043 | 842 | IPQAFIKDNSIDNRVLTSSKENRG-KSDD--VP | S--BDVVRKMKS-YWSKLLSAKLITQRKFPDNLTKA--ERGGLTD | 910 |
| WP_002269448 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_002271977 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002272766 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002273241 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002275430 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002276448 | 842 | IPQAFIKDNSIDNRVLTSSKANRG-KSDD--VP | S--KDVVRKMKP-YWMNKLLSSGLISAKLITQRKFPDNLTKA--ERGGLTD | 910 |
| WP_002277050 | 847 | IPQAFIKDNSIDNRVLTSSKENRG-KSDN--VP | S--BDVVNRMRP-FWNKLLSSGLISQRKYNNLTKK--E---LTP | 912 |
| WP_002277364 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_002279025 | 842 | IPQAFIKDNSIDNRVLTSSKENRG-KSDD--VP | S--KDVVRKMKP-YWSKLLSAKLITQRKFPDNLTKG--ERGGLTD | 910 |
| WP_002279859 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002280230 | 842 | IPQAFIKDNSIDNRVLTSSKENRG-KSDD--VP | S--KDVVRKMKP-YWSKLLSAKLITQRKFPDNLTKG--ERGGLTD | 910 |
| WP_002281696 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_002282247 | 847 | IPQAFIKDNSIDNRVLTSSKENRG-KSDD--VP | S--BDVVNRMRP-FWNKLLSSGLISQRKYNNLTKK--E---LTL | 912 |
| WP_002282906 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002283846 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_002287255 | 847 | IPQAFIKDNSIDNRVLTSSKENRG-KSDN--VP | S--BDVVNRMRP-FWNKLLSSGLISQRKYNNLTKK--E---LTP | 912 |
| WP_002288990 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002289641 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_002290427 | 842 | IPQAFIKDNSIDNRVLTSSKENRG-KSDD--VP | S--KDVVRKMKP-YWSKLLSAKLITQRKFPDNLTKG--ERGGLTD | 910 |
| WP_002295753 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_002296423 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_002304487 | 856 | IPQAFIKDNSIDNRVLTRSDKNRG-KSDD--VP | S--BEVVHKMKP-FWSKLLSAKLITQRKFPDNLTKA--ERGGLTD | 924 |
| WP_002305844 | 842 | IPQAFIKDNSIDNRVLTSSKENRG-KSDD--VP | S--KDVVRKMKS-YWSKLLSAKLITQRKFPDNLTKA--ERGGLTD | 910 |

-continued

| | | | | | |
|---|---|---|---|---|---|
| WP_002307203 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_002310390 | 842 | IPQAFIKDNSIDNRVLTSSKENRG-KSDD--VP | S--KDVVRKMKS-YWSKLLSAKLITQRKFPDNLTKG--ERGGLTD | 910 |
| WP_002352408 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_012997688 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_014677909 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019312892 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_019313659 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019314093 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019315370 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_019803776 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019805234 | 842 | IPQAFIKDNSIDNRVLTSSKENRG-KSDD--VP | S--KDVVRKMKS-YWSKLLSAKLITQRKFPDNLTKG--ERGGLTD | 910 |
| WP_024783594 | 842 | IPQAFIKDNSIDNRVLTSSKENRG-KSDD--VP | S--KDVVRKMKS-YWSKLLSAKLITQRKFPDNLTKG--ERGGLTD | 910 |
| WP_024784288 | 847 | IPQAFIKDNSIDNRVLTSSKANRG-KSDN--VP | S--EDVVNRMRP-FWNKLLSSGLISQRKYNNLTKK--E---LTL | 912 |
| WP_024784666 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_024784894 | 842 | IPQAFIKDNSIDNRVLTSSKANRG-KSDD--VP | S--KNVVRKMKS-YWSKLLSSGLISQRKYNNLTKK--E---LTL | 910 |
| WP_024786433 | 847 | IPQAFIKDNSIDNRVLTSSKANRG-KSDN--VP | S--EDVVNRMRP-FWNKLLSSGLISQRKYNNLTKK--E---LTL | 912 |
| WP_049473442 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_049474547 | 842 | IPQAFIKDNSIDNRVLTSSKENRG-KSDD--VP | S--KNVVRKMKS-YWSKLLSAKLITQRKFPDNLTKA--ERGGLTD | 910 |
| EMC03581 | 835 | VPQAFIKDDSLDNRVLTSLKDNRG-KSDD--VP | S--LEVVEKMKT-FWQQLLDSKLISYRKFPNLTKA--ERGGLTD | 903 |
| WP_000428612 | 847 | VPQAFIKDDSLDNRVLTSLKDNRG-KSDN--VP | S--IEVVQKRKA-FWQQLLDSKLISERKFPNNLTKA--ERGGLDE | 915 |
| WP_000428613 | 845 | IPQAFIKDDSLDNRVLTSSKDNRG-KSDN--VP | S--IEVVEKMKG-FWQQLLDSKLISERKFPNNLTKA--KRGGLDE | 913 |
| WP_049522028 | 840 | IPQAFIKDDSLDNRVLTSSKDNRG-KSDN--VP | S--IAIVNKMKS-YWQHQLKSGAISQRKEDNLTKA--ERGGLSE | 908 |
| WP_003107102 | 811 | IPRSFIKDDSIDNKVLTRSEHNRG-KTDN--VP | Y--LEIVEKMKG-YWQKLLDTKVISQRKFPNLTKA--ERGGLQE | 879 |
| WP_054279288 | 843 | IPQAFIKDDSLDNKVLTKSAKNRG-KSDN--VP | S--LEVVQKRKA-FWQQLLESKLISERKFPNNLTKA--ERGGLNE | 911 |
| WP_049531101 | 845 | IPQAFIKDDSLDNRVLTSSKENRG-KSDN--VP | C--LEVVDKMKV-FWQQLLDFKLISYRKFPNNLTKA--ERGGLDE | 913 |
| WP_049538452 | 845 | IPQAFIKDDSLDNKVLTKSAKNRG-KSDN--VP | S--LEVVQKRKA-FWQQLLDSKLISERKFPNNLTKA--ERGGLDE | 913 |
| WP_049549711 | 845 | IPQAFIKDDSFDNRVLTSSKENRG-KSDN--VP | S--IEVVRDMKD-YWRRQLANGAISRQKFPDHLTKA--erERDGLNE | 915 |
| WP_007896501 | 847 | IPQSFIKDNSIDNLVLTTQKANRG-KSDN--VP | S--IEVVRDMKD-rVWRRQLANGAISRQKFPDHLTKA--ERGGLAD | 916 |
| EFR44625 | 799 | LPQSYIKDSIENLALVKKVENQR-KKDS11LN | S--SIINQNYS-RWEQLKNAGLIGEKKFPNLTRTk----ITD | 868 |
| WP_002897477 | 844 | IPQAFIKDDSIDNRVLTSSKDNRG-KSDN--VP | S--LEVVQKRKA-FWQQLLDSKLISERKFPNNLTKA--ERGGLDE | 912 |
| WP_002906454 | 844 | IPQAFIKDDSLDNRVLTSSKDNRG-KSDN--VP | S--IEVVQKRKA-FWQQLLDSKLISERKFPNNLTKA--KRGGLDE | 912 |
| WP_009729476 | 845 | IPQAFIKDDSLDNRVLTSSKDNRG-KSDN--VP | S--LEVVDKMKV-FWQQLLDSKLISYRKFPNNLTKA--ERGGLNE | 913 |
| CQR24647 | 844 | IPQSFIKDNSLDNRVLTNSKSNRG-KSDN--VP | S--NEVVEKMKG-FWQQLLDSKLISERKFPNNLTKAerERGGLNE | 912 |
| WP_000066813 | 847 | IPQSFIKDNSLDNRVLTSSKKDNRG-KSDN--VP | S--LEVVEKMKA-FWQQLLDSKLISERKFPNNLTKA--ERGGLNE | 917 |
| WP_009754323 | 845 | IPQAFIKDDSLDNRVLTKSAKNRG-KSDN--VP | S--LEVVKRKA-FWKQLLDSQLISQRKFPNNLTKA--ERGGLDE | 913 |
| WP_044674937 | 844 | IPQAFIKDDSLDNRVLTKSAKNRG-KSDN--VP | S--LEIVHCKKN-YWRQLLNAKLITQRKFPNNLTKA--ERGGLTN | 912 |
| WP_044676715 | 846 | IPQAFIKDDSLDNRVLTKSAKNRG-KSDN--VP | S--LEIVHCKKN-FWKQLLDSQLISQRKFPNNLTKA--ERGGLDE | 914 |
| WP_044680361 | 846 | IPQAFIKDDSLDNKVLTKSAKNRG-KSDN--VP | S--LEIVHCKKN-FWKQLLDSQLISQRKFPNNLTKA--ERGGLDE | 914 |
| WP_044681799 | 844 | IPQAFIKDDSLDNKVLTKSAKNRG-KSDN--VP | S--LEIVHCKKN-FWKQLLDSQLISQRKFPNNLTKA--ERGGLTN | 912 |
| WP_049533112 | 841 | IPQAFIKDDSLDNKVLVSSKENRL-KSDD--VP | D--QKVVIRMRR-YWEKLLRANLISERKFAYLTKLe--LTP | 909 |
| WP_029090905 | 824 | LPQSYIKDNSIENLALVKKVENQR-KKDS11LN | S--SIINQNYS-RWEQLKNAGLIGEKKFPNLTRTk----ITD | 890 |
| WP_006506696 | 850 | VPQSLVKDDSEDNRVLVVPSENQR-KLDD1vVP | ---FDIRDKMYR-FWKLLFDHELISPKKFYSLIKTe----YTE | 916 |
| AIT42264 | 842 | IPQSFLKDDSIDNKVLTRSDKNRG-KSDN--VP | S--EEVVKKMKN-YWRQLLNAKLITQRKFPDNLTKGk----LTD | 910 |
| WP_034440723 | 849 | IPRSFITDNSEDNIVLTSSTVNRG-KLDN--VP | Sp--DIVRQQKG-FWKQLLRAGLMSQRKFPNNLTKA---LTD | 914 |
| AKQ21048 | 842 | VPQSFLKDDSIDNKVLTRSDNRG-KSDN--VP | S--EEVVKKMKN-YWRQLLNAKLITQRKFPNNLTKA--ERGGLSE | 910 |
| WP_004636532 | 846 | IPQSFTTDNSIDNKVLVSRTKNQGnKSDD--VP | S--INIVHKMKP-FWRQLHKAGLISDRKFKNLTKA--EHGGLTE | 915 |
| WP_002364836 | 853 | IPQSFMKDDSLDNLVLVLVGSTENRG-KSDN--VP | S--KEVVKDMKA-YWEKLYAAGLISQRKFQRLTKG--EQGGLTL | 921 |
| WP_016631044 | 804 | IPQSFMKDDSLDNLVLVLVGSTENRG-KSDN--VP | S--KEVVKDMKA-YWEKLYAAGLISQRKFQRLTKG--EQGGLTL | 872 |
| EMS75795 | 589 | IPRSFIVDNSIDNKVLVSSKENRL-KMDD--VP | D--QKVVIRMRR-YWEKLRANLISERKFAYLTKLe--LTP | 654 |
| WP_002373311 | 853 | IPQSFMKDDSLDNLVLVLVGSTENRG-KSDN--VP | S--KKVVKKMKA-YWEKLYAAGLISQRKFQRLTKG--EQGGLTL | 921 |
| WP_002378009 | 853 | IPQSFMKDDSLDNLVLVLVGSTENRG-KSDN--VP | S--KEVVKDMKA-YWEKLYAAGLISQRKFQRLTKG--EQGGLTL | 921 |
| WP_002407324 | 853 | IPQSFMKDDSLDNLVLVLVGSTENRG-KSDN--VP | S--KEVVKDMKA-YWEKLYAAGLISQRKFQRLTKG--EQGGLTL | 921 |
| WP_002413717 | 853 | IPQSFMKDDSLDNLVLVLVGSTENRG-KSDN--VP | S--KEVVKDMKA-YWEKLYAAGLISQRKFQRLTKG--EQGGLTL | 921 |

-continued

| | | | | |
|---|---|---|---|---|
| WP_010775580 | 855 | IPQSFMKDDSLDNLVLVGSTENRG-KSDD--VP | S--KEVVKKMKA-YWEKLYAAGLISQRKFQRLTKG-EQGGLTL | 923 |
| WP_010818269 | 853 | IPQSFMKDDSLDNLVLVGSTENRG-KSDD--VP | S--KEVVKDMKA-YWEKLYAAGLISQRKFQRLTKG-EQGGLTL | 921 |
| WP_010824395 | 853 | IPQSFMKDDSLDNLVLVGSTENRG-KSDD--VP | S--KEVVKDMKA-YWEKLYAAGLISQRKFQRLTKG-EQGGLTL | 921 |
| WP_016622645 | 853 | IPQSFMKDDSLDNLVLVGSTENRG-KSDD--VP | S--KEVVKDMKA-YWEKLYAAGLISQRKFQRLTKG-EQGGLTL | 921 |
| WP_033624816 | 853 | IPQSFMKDDSLDNLVLVGSTENRG-KSDD--VP | S--KEVVKKMKA-YWEKLYAAGLISQRKFQRLTKG-EQGGLTL | 921 |
| WP_033625576 | 853 | IPQSFMKDDSLDNLVLVGSTENRG-KSDD--VP | S--KEVVKKMKA-YWEKLYAAGLISQRKFQRLTKG-EQGGLTL | 921 |
| WP_033789179 | 853 | IPQSFMKDDSLDNLVLVGSTENRG-KSDD--VP | S--KEVVKQMKA-YWEKLYAAGLISQRKFQRLTKG-EQGGLTL | 921 |
| WP_002310644 | 854 | IPRSFTTDNSIDNKVLVSSKENRL-KKDD--VP | S--BKVVKKMRS-FWYDLYSSKLISKRKLDNLTKIk----LTE | 918 |
| WP_002312694 | 854 | IPRSFTTDNSIDNKVLVSSKENRL-KKDD--VP | S--EKVVKKMRS-FWYDLYSSKLISKRKLDNLTKIk----LTE | 919 |
| WP_002314015 | 854 | IPRSFTTDNSIDNKVLVSSKENRL-KKDD--VP | S--EKVVKKMRS-FWYDLYSSKLISKRKLDNLTKIk----LTE | 919 |
| WP_002320716 | 854 | IPRSFTTDNSIDNKVLVSSKENRL-KKDD--VP | S--EKVVKKMRS-FWYDLYSSKLISKRKLDNLTKIk----LTE | 919 |
| WP_002330729 | 853 | IPRSFTTDNSIDNKVLVSSKENRL-KKDD--VP | S--EKVVKKMRS-FWYDLYSSKLISKRKLDNLTKIk----LTE | 918 |
| WP_002335161 | 854 | IPRSFTTDNSIDNKVLVSSKENRL-KKDD--VP | S--EKVVKKMRS-FWYDLYSSKLISKRKLDNLTKIk----LTE | 919 |
| WP_002345439 | 854 | IPRSFTTDNSIDNKVLVSSKENRL-KKDD--VP | S--EKVVKKMRS-FWYDLYSSKLISKRKLDNLTKIk----LTE | 919 |
| WP_034867970 | 845 | IPRSFIVDNSIDDKVLVASKQNQK-KRDD--VP | K--KQIVNEQRI-FWNQLKEAKLISPKKYAYLIKIe----LTP | 910 |
| WP_047937432 | 854 | IPRSFIVDNSIDNKVLVASKQNQK-KRDD--VP | K--KQIVNEQRI-FWNQLKEAKLISPKKYAYLIKIe----LTP | 919 |
| WP_010720994 | 845 | IPRSFIVDNSIDNKVLVASKQNQK-KRDD--VP | K--KQIVNEQRI-FWNQLKEAKLISPKKYAYLIKIe----LTP | 910 |
| WP_010730004 | 845 | IPRSFIVDNSIDNRVLTSKNRPL-KKDD--VP | K--KQIVNEQRI-FWNQLKEAKLISPKKYAYLIKIe----LTP | 910 |
| WP_034700478 | 846 | IPQSFLTDNSIDNRVLTSKSNPG-KKDD--VP | N--KQIVNEQRI-FWDLYSSKLISERKYTNLTKKe----LTE | 911 |
| WP_007209003 | 839 | IPRSFIVDNSLDNRVLVSSKVNRG-KLDN--AP | D--PLVVKRMRS-HWEKLHQAKLISDKKLANLTKQn----LTE | 904 |
| WP_023519017 | 846 | IPQSFTTDNSLDNRVLVSSKENRG-KKDD--VP | S--KEVVQKNIT-LWETLKNSNLISQKYDNLTKG-LRGGLTE | 914 |
| WP_010770040 | 843 | IPRSFLKDDSIENKVLTIKKENVR-KTNG--LP | L--EAVIQKMGS-FWKKLLDAGAMTNKKYDNLRRN1-HGGLNE | 911 |
| WP_048604708 | 848 | IPRSFIVDHSLDNKVLVLTRSDKNRG-KSDN--VP | D--SKVVKRMKA-FWESLYRSGLISKKKFDNLVKA-ESGGLSE | 918 |
| WP_010750235 | 881 | VPQSFLKDDSIDNKVLVLSSENQR-KLDD1vIP | S--BEVVKKMKN-YWRQLLNAKLITQRKFDNLTKA-ERGGLSE | 949 |
| AII6583 | 861 | VPQSLLKDDSIDNKVLVLSSENQR-KLDD1vIP | ---EMIRNKMFG-FWNKLYENKIISPKKFYSLIKSe----YSD | 927 |
| WP_029073316 | 861 | VPQSLLKDDSIDNKVLVLSSENQR-KLDD1vIP | ---SSIRNKMYG-FWEKLFNNKIISPKKFYSLIKTe----FNE | 927 |
| WP_031589969 | 834 | IPQSFLKDDSIENKVLTIKKENVR-KTNG--LP | L--EAVIQKMGS-FWKKLLDAGAMTNKKYDNLRRN1-HGGLNE | 902 |
| KDA45870 | 857 | LPQSFLKDNSLDNRVLVSQRMNRS-KADQ--VP | S--VELGQKMQI-QWEQMLRAGLITKKKYDNLTLNp---- | 923 |
| WP_039099354 | 859 | LPRTYIPDDSLENKALVLAKENQR-KADD11LN | S--NVIDKNLE-RWTYMLNNNMGLKKFKNLTRRv----ITD | 925 |
| AKP02966 | 845 | VPQSFITDNSIDNLVLTSSAGNRE-KGDD--VP | P--LEIVRKRKA-FWEKLYQGNLMSKRKFPDYLTKA-ERGGLTE | 913 |
| WP_010991369 | 845 | VPQSFITDNSIDNLVLTSSAGNRE-KGDD--VP | P--LEIVRKRKA-FWEKLYQGNLMSKRKFPDYLTKA-ERGGLTE | 913 |
| WP_003838504 | 848 | VPQSFITDNSIDNLVLTSSAGNRE-KGDN--VP | P--LEIVRKRKA-FWEKLYQGNLMSKRKFPDYLTKA-ERGGLTE | 916 |
| EHN60060 | 614 | VPQSFITDNSIDNLVLTSSAGNRE-KGND--VP | P--LEIVQKRKV-FWEKLYQGNLMSKRKFPDYLTKA-ERGGLTE | 682 |
| EFR89594 | 845 | VPQSFITDNSIDNRVLVSSTANRE-KGDN--VP | L--LEVVRKRKA-FWEKLYQAKLMSKRKFPDYLTKA-ERGGLTE | 913 |
| WP_038409211 | 464 | VPQSFITDNSIDNRVLVSSTANRE-KGDN--VP | L--LEVVRKRKA-FWEKLYQAKLMSKRKFPDYLTKA-ERGGLTE | 532 |
| EFR95520 | 845 | VPQSFITDNSIDNLVLTSSAGNRE-KGDD--VP | P--LEIVRKRKI-FWEKLYQGNLMSKRKFPDYLTKA-ERGGLTE | 913 |
| WP_003723650 | 845 | VPQSFITDNSIDNLVLTSSAGNRE-KGGD--VP | P--LEIVQKRKI-FWEKLYQGNLMSKRKFPDYLTKA-ERGGLTE | 913 |
| WP_003727705 | 845 | VPQSFITDNSIDNLVLTSSAGNRE-KGDN--VP | P--LEIVQKRKI-FWEKLYQGNLMSKRKFPDYLTKA-ERGGLTE | 913 |
| WP_003730785 | 845 | VPQSFITDNSIDNLVLTSSAGNRE-KGGD--VP | P--LEIVQKRKI-FWEKLFQGNLMSKRKFPDYLTKA-ERGGLTE | 913 |
| WP_003733029 | 845 | VPQSFITDNSIDNLVLTSSAGNRE-KGDN--VP | P--LEIVQKRKI-FWEKLFQGNLMSKRKFPDYLTKA-ERGGLTE | 913 |
| WP_003739838 | 845 | VPQSFITDNSIDNLVLTSSAGNRE-KGDN--VP | P--LEIVQKRKI-FWEKLFQGNLMSKRKFPDYLTKA-ERGGLTE | 913 |
| WP_014601172 | 845 | VPQSFITDNSIDNLVLTSSAGNRE-KGGD--VP | P--LEIVQKRKI-FWEKLFQGNLMSKRKFPDYLTKA-ERGGLTE | 913 |
| WP_023548323 | 845 | VPQSFITDNSIDNLVLTSSAGNRE-KGDN--VP | P--LEIVQKRKI-FWEKLYQGNLMSKRKFPDYLTKA-ERGGLTD | 913 |
| WP_031665337 | 845 | VPQSFITDNSIDNLVLTSSAGNRE-KGGD--VP | P--LEIVQKRKI-FWEKLYQGNLMSKRKFPDYLTKA-ERGGLTE | 913 |
| WP_031669209 | 845 | VPQSFITDNSVDNLVLTSSAANRE-KGDN--VP | P--LEIVQKRKI-FWEKLYQGNLMSKRKFPDYLTKA-ERGGLTE | 913 |
| WP_033920898 | 848 | VPQSFITDNSIDNLVLTSSAANRE-KGDN--VP | S--LEIVQKRKI-FWEKLYQGNLMSKRKFPDYLTKA-ERGGLTE | 916 |
| AKI42028 | 848 | VPQSFITDNSIDNLVLTSSAGNRE-KGGD--VP | P--LEIVQKRKI-FWEKLYQGNLMSKRKFPDYLTKA-ERGGLTD | 916 |
| AKI50529 | 293 | VPQSFITDNSIDNLVLTSSAGNRE-KGDN--VP | P--LEIVQKRKI-FWEKLYQGNLMSKRKFPDYLTKA-ERGGLTE | 361 |
| EFR83390 | 845 | VPQSFITDNSIDNLVLTSSAANRE-KGDN--VP | S--LEVVRKRKI-FWEKLYQGNLMSKRKFPDYLTKA-ERGGLTE | 913 |
| WP_046323366 | 858 | VPQSLVKDDSFDNRVLVLTRSDKNRG-KSDN--VP | S--EEVVKKMKN-YWRQLLNAKLITQRKFDNLTKA-ERGGLSE | 926 |
| AKE81011 | 854 | VPQSLVKDDSFDNRVLVLPSENQR-KLDD1vVP | ---FDIRDKMYR-FWKLLFDHELISPKKFYSLIKTe----YTE | 920 |
| CUO82355 | | | | |
| WP_033162887 | 856 | LPQSLIKDDSFDNRVLVLPEENQW-KLDSetVP | ---FEIRNKMIG-FWQMLHENGLMSNKKFFSLIRTd----FSD | 922 |

```
                         -continued

AGZ01981       875  VPQSFLKDDSIDNKVLTRSDKNRG-KSDN--VP S--EEVVKKMKN-YWRQLLNAKLITQRKFPDNLTKA--ERGGLSE  943
AKA60242       842  VPQSFLKDDSIDNKVLTRSDKNRG-KSDN--VP S--EEVVKKMKN-YWRQLLNAKLITQRKFPDNLTKA--ERGGLSE  910
AKS40380       842  VPQSFLKDDSIDNKVLTRSDKNRG-KSDN--VP S--EEVVKKMKN-YWRQLLNAKLITQRKFPDNLTKA--ERGGLSE  910
4UN5_B         846  VPQSFLKDDSIDNKVLTRSDKNRG-KSDN--VP S--EEVVKKMKN-YWRQLLNAKLITQRKFPDNLTKA--ERGGLSE  914
WP_010922251   911  LD KAGFIKRQLVETRQITKHVAQILDSRMNTKYDENDKLIR--EVKVITLKSKLVSDERKDF QFYKVREINNY     981
AKA60242       921  AD KVGFIKRQLVETRQITKHVAQILDARFNTEHDENDKVIR--DVKVITLKSNLVSQFRKDF EFYKVREINDY     991
WP_039695303   913  RD KVGFIKRQLVETRQITKHVAQILDARYNTEVNEKDKKNR--TVKIITLKSNLVSNERKEF RLYKVREINDY     983
WP_045635197   633  RD QKDFINRNLVDTRYATRGLMNLLRSYFR--------VNn1DVKVKSINGGFTSPLRRKW KFFKKERNKGYK     702
5AXW_A         595  LD KAGFIKRQLVETRQITKHVAQILDSRMNTKYDENDKLIR--EVKVITLKSKLVSDERKDF QFYKVREINNY     665
WP_009880683   911  LD KAGFIKRQLVETRQITKHVAQILDSRMNTKYDENDKLIR--EVKVITLKSKLVSDERKDF QFYKVREINNY     981
WP_010922251   911  LD KAGFIKRQLVETRQITKHVAQILDSRMNTKYDENDKLIR--EVKVITLKSKLVSDERKDF QFYKVREINNY     981
WP_011054416   911  LD KAGFIKRQLVETRQITKHVAQILDSRMNTKYDENDKLIR--EVKVITLKSKLVSDERKDF QFYKVREINNY     981
WP_011284745   911  LD KAGFIKRQLVETRQITKHVAQILDSRMNTKYDENDKLIR--EVKVITLKSKLVSDERKDF QFYKVREINNY     981
WP_011285506   911  LD KAGFIKRQLVETRQITKHVAQILDSRMNTKYDENDKLIR--EVKVITLKSKLVSDERKDF QFYKVREINNY     981
WP_011527619   911  LD KAGFIKRQLVETRQITKHVAQILDSRMNTKYDENDKLIR--EVKVITLKSKLVSDERKDF QFYKVREINNY     981
WP_012560673   911  LD KAGFIKRQLVETRQITKHVAQILDSRMNTKYDENDKLIR--EVKVITLKSKLVSDERKDF QFYKVREINNY     981
WP_014407541   910  LD KAGFIKRQLVETRQITKHVAQILDSRMNTKYDENDKLIR--EVKVITLKSKLVSDERKDF QFYKVREINNY     980
WP_020905136   910  LD KAGFIKRQLVETRQITKHVAQILDSRMNTKYDENDKLIR--EVKVITLKSKLVSDERKDF QFYKVREINNY     980
WP_023080005   910  LD KAGFIKRQLVETRQITKHVAQILDSRMNTKYDENDKLIR--EVKVITLKSKLVSDERKDF QFYKVREINNY     980
WP_023610282   911  LD KAGFIKRQLVETRQITKHVAQILDSRMNTKYDENDKLIR--EVKVITLKSKLVSDERKDF QFYKVREINNY     981
WP_024262016   911  LD KAGFIKRQLVETRQITKHVAQILDSRMNTKYDENDKLIR--EVKVITLKSKLVSDERKDF QFYKVREINNY     981
WP_030125963   911  LD KAGFIKRQLVETRQITKHVAQILDSRMNTKYDENDKLIR--EVKVITLKSKLVSDERKDF QFYKVREINNY     981
WP_030126706   911  LD KAGFIKRQLVETRQITKHVAQILDSRMNTKYDENDKLIR--EVKVITLKSKLVSDERKDF QFYKVREINNY     981
WP_031488318   911  LD KAGFIKRQLVETRQITKHVAQILDSRMNTKYDENDKLIR--EVKVITLKSKLVSDERKDF QFYKVREINNY     981
WP_032460140   911  LD KAGFIKRQLVETRQITKHVAQILDSRMNTKYDENDKLIR--EVKVITLKSKLVSDERKDF QFYKVREINNY     981
WP_032461047   911  LD KAGFIKRQLVETRQITKHVAQILDSRMNTKYDENDKLIR--EVKVITLKSKLVSDERKDF QFYKVREINNY     981
WP_032462016   911  LD KAGFIKRQLVETRQITKHVAQILDSRMNTKYDENDKLIR--EVKVITLKSKLVSDERKDF QFYKVREINNY     981
WP_032462936   911  LD KAGFIKRQLVETRQITKHVAQILDSRMNTKYDENDKLIR--EVKVITLKSKLVSDERKDF QFYKVREINNY     981
WP_032464890   911  LD KAGFIKRQLVETRQITKHVAQILDSRMNTKYDENDKLIR--EVKVITLKSKLVSDERKDF QFYKVREINNY     981
WP_033888930   736  LD KAGFIKRQLVETRQITKHVAQILDSRMNTKYDENDKLIR--EVKVITLKSKLVSDERKDF QFYKVREINNY     806
WP_038431314   911  LD KAGFIKRQLVETRQITKHVAQILDSRMNTKYDENDKLIR--EVKVITLKSKLVSDERKDF QFYKVREINNY     981
WP_038432938   910  LD KAGFIKRQLVETRQITKHVAQILDSRMNTKYDENDKLIR--EVKVITLKSKLVSDERKDF QFYKVREINNY     980
WP_038434062   911  LD KAGFIKRQLVETRQITKHVAQILDSRMNTKYDENDKLIR--EVKVITLKSKLVSDERKDF QFYKVREINNY     981
BAQ51233       822  LD KVGFIKRQLVETRQITKHVAQILDSRMNTKYDENDKLIR--EVKVITLKSKLVSDERKDF QFYKVREINNY     892
KGE60162       86   --  ----------------------------------------  ----------------------- --------  156
KGE60856       911  LD KAGFIKRQLVETRQITKHVAQILDSRMNTKYDENDKLIR--EVKVITLKSKLVSDERKDF QFYKVREINNY     981
WP_002989955   910  ED KAGFIQRQLVETRQITKHVAQILDERFNTEFDGNKFRIR--NVKIITLKSNLVSNFRKEF ELYKVREINNY     980
WP_003030002   921  AD KARFIQRQLVETRQITKHVAQILDARFNTESDENDKVIR--DVKVITLKSNLVSQFRKDF EFYKVREINDY     991
WP_003065552   916  DD KARFIQRQLVETRQITKHVARILDERFNNELDSKGRRIR--KVKIVTLKSNLVSNFRKEF VFYKIREVNDY     986
WP_001040076   916  DD KARFIQRQLVETRQITKHVARILDERFNNELDSKGRRIR--KVKIVTLKSNLVSNFRKEF GFYKIREVNDY     986
WP_001040078   916  DD KARFIQRQLVETRQITKHVARILDERFNNELDSKGRRIR--KVKIVTLKSNLVSNFRKEF GFYKIREVNNY     986
WP_001040080   916  DD KARFIQRQLVETRQITKHVARILDERFNNELDSKGRRIR--KVKIVTLKSNLVSNFRKEF GFYKIREVNNY     986
WP_001040081   916  DD KARFIQRQLVETRQITKHVARILDERFNNELDSKGRRIR--KVKIVTLKSNLVSNFRKEF GFYKIREVNNY     986
WP_001040083   916  DD KARFIQRQLVETRQITKHVARILDERFNNELDSKGRRIR--KVKIVTLKSNLVSNFRKEF GFYKIREVNNY     986
WP_001040085   916  DD KARFIQRQLVETRQITKHVARILDERFNNELDSKGRRIR--KVKIVTLKSNLVSNFRKEF GFYKIREVNNY     986
WP_001040087   916  DD KARFIQRQLVETRQITKHVARILDERFNNELDSKGRRIR--KVKIVTLKSNLVSNFRKEF GFYKIREVNNY     986
WP_001040088   916  DD KARFIQRQLVETRQITKHVARILDERFNNELDSKGRRIR--KVKIVTLKSNLVSNFRKEF GFYKIREVNNY     986
WP_001040089   916  DD KARFIQRQLVETRQITKHVARILDERFNNELDSKGRRIR--KVKIVTLKSNLVSNFRKEF GFYKIREVNNY     986
WP_001040090   916  DD KARFIQRQLVETRQITKHVARILDERFNNELDSKGRRIR--KVKIVTLKSNLVSNFRKEF GFYKIREVNNY     986
WP_001040091   916  DD KARFIQRQLVETRQITKHVARILDERFNNELDSKGRRIR--KVKIVTLKSNLVSNFRKEF GFYKIREVNNY     986
WP_001040092   916  DD KARFIQRQLVETRQITKHVARILDERFNNELDSKGRRIR--KVKIVTLKSNLVSNFRKEF GFYKIREVNNY     986
WP_001040094   916  DD KARFIQRQLVETRQITKHVARILDERFNNKLDSKGRRIR--KVKIVTLKSNLVSNFRKEF GFYKIREVNNY     986
WP_001040095   916  DD KARFIQRQLVETRQITKHVARILDERFNNELDSKGRRIR--KVKIVTLKSNLVSNFRKEF GFYKIREVNNY     986
WP_001040096   916  DD KARFIQRQLVETRQITKHVARILDERFNNELDSKGRRIR--KVKIVTLKSNLVSNFRKEF GFYKIREVNNY     986
WP_001040097   916  DD KARFIQRQLVETRQITKHVARILDERFNNELDSKGRRIR--KVKIVTLKSNLVSNFRKEF GFYKIREVNNY     986
```

```
-continued
WP_001040098    916 DD KARFIQRQLVETRQITKHVARILDERFNNELDSKGRRIR--KVKIVTLKSNLVSNFRKEF GFYKIREVNNY 986
WP_001040099    916 DD KARFIQRQLVETRQITKHVARILDERFNNELDSKGRRIR--KVKIVTLKSNLVSNFRKEF GFYKIREVNNY 986
WP_001040100    916 DD KARFIQRQLVETRQITKHVARILDERFNNELDSKGRRIR--KVKIVTLKSNLVSNFRKEF GFYKIREVNNY 986
WP_001040104    916 DD KARFIQRQLVETRQITKHVARILDERFNNELDSKGRRIR--KVKIVTLKSNLVSNFRKEF GFYKIREVNNY 986
WP_001040105    916 DD KARFIQRQLVETRQITKHVARILDERFNNELDSKGRRIR--KVKIVTLKSNLVSNFRKEF GFYKIREVNDY 986
WP_001040106    916 DD KARFIQRQLVETRQITKHVARILDERFNNELDSKGRRIR--KVKIVTLKSNLVSNFRKEF GFYKIREVNDY 986
WP_001040107    916 DD KARFIQRQLVETRQITKHVARILDERFNNELDSKGRRIR--KVKIVTLKSNLVSNFRKEF GFYKIREVNDY 986
WP_001040108    916 DD KARFIQRQLVETRQITKHVARILDERFNNELDSKGRRIR--KVKIVTLKSNLVSNFRKEF GFYKIREVNDY 986
WP_001040109    916 DD KARFIQRQLVETRQITKHVARILDERFNNELDSKGRRIR--KVKIVTLKSNLVSNFRKEF GFYKIREVNDY 986
WP_001040110    916 DD KAGFIQRQLVETRQITKHVARILDERFNNELDSKGRRIR--KVKIVTLKSNLVSNFRKEF GFYKIREVNDY 986
WP_015058523    916 DD KARFIQRQLVETRQITKHVARILDERFNNKVDDNNKPIR--KVKIVTLKSNLVSNFRKEF GFYKIREVNNY 986
WP_017643650    916 DD KARFIQRQLVETRQITKHVARILDERFNNELDSKGRRIR--KVKIVTLKSNLVSNFRKEF GFYKIREVNNY 986
WP_017647151    916 DD KARFIQRQLVETRQITKHVARILDELFNNELDSKGRRIR--KVKIVTLKSNLVSNFRKEF GFYKIREVNNY 986
WP_017648376    916 DD KARFIQRQLVETRQITKHVARILDERFNNELDSKGRRIR--KVKIVTLKSNLVSNFRKEF GFYKIREVNNY 986
WP_017649527    916 DD KARFIQRQLVETRQITKHVARILDERFNNELDSKGRRIR--KVKIVTLKSNLVSNFRKEF GFYKIREVNNY 986
WP_017771611    916 DD KARFIQRQLVETRQITKHVARILDERFNNELDSKGRRIR--KVKIVTLKSNLVSNFRKEF GFYKIREVNDY 986
WP_017771984    916 DD KARFIQRQLVETRQITKHVARILDERFNNELDSKGRRIR--KVKIVTLKSNLVSNFRKEF GFYKIREVNDY 986
CFQ25032        916 DD KARFIQRQLVETRQITKHVARILDERFNNELDSKGRRIR--KVKIVTLKSNLVSNFRKEF GFYKIREVNNY 986
CFV16040        916 DD KARFIQRQLVEIRQITKHVARILDERFNNELDSKGRRIR--KVKIVTLKSNLVSNFRKEF GFYKIREVNNY 986
KLJ37842        916 DD KAGFIQRQLVETRQITKHVARILDERFNNELDSKGRRIR--KVKIVTVKSNLVSNFRKEF GFYKIREVNNY 986
KLJ72361        930 DD KARFIQRQLVETRQITKHVARILDERFNNELDSKGRRIR--KVKIVTLKSNLVSNFRKEF GFYKIREVNNY 1000
KLL20707        916 DD KARFIQRQLVETRQITKHVARILDERFNNELDSKGRRIR--KVKIVTLKSNLVSNFRKEF GFYKIREVNNY 986
KLL42645        916 DD KARFIQRQLVETRQITKHVASILDERFNNELDSKGRRIR--KVKIVTLKSNLVSNFRKEF GFYKIREVNNY 986
WP_047207273    916 DD KARFIQRQLVETRQITKHVARILDERFNNELDSKGRRIR--KVKIVTLKSNLVSNFRKEF GFYKIREVNDY 986
WP_047209694    916 DD KARFIQRQLVETRQITKHVARILDERFNNELDSKGRRIR--KVKIVTLKSNLVSNFRKEF GFYKIREVNDY 986
WP_050198062    916 DD KARFIQRQLVETRQITKHVARILDERFNNELDSKGRRIR--KVKIVTLKSNLVSNFRKEF GFYKIREVNDY 986
WP_050201642    916 DD KARFIQRQLVETRQITKHVARILDERFNNELDSKGRRIR--KVKIVTLKSNLVSNFRKEF GFYKIREVNNY 986
WP_050204027    916 DD KARFIQRQLVETRQITKHVARILDERFNNELDSKGRRIR--KVKIVTLKSNLVSNFRKEF GFYKIREVNNY 986
WP_050881965    916 DD KARFIQRQLVETRQITKHVARILDERFNNELDSKGRRIR--KVKIVTLKSNLVSNFRKEF GFYKIREVNNY 986
WP_050886065    916 DD KARFIQRQLVETRQITKHVARILDERFNNKVDDNNKPIR--KVKIVTLKSNLVSNFRKEF GFYKIREVNNY 986
AHN30376        916 DD KARFIQRQLVETRQITKHVARILDERFNNELDSKGRRIR--KVKIVTLKSNLVSNFRKEF GFYKIREVNNY 986
EA078426        916 DD KARFIQRQLVETRQITKHVARILDERFNNELDSKGRRIR--KVKIVTLKSNLVSNFRKEF GFYKIREVNNY 986
CCW42055        916 ND KARFIQRQLVETRQITKHVAQVLDARFNAKHDENKKVIR--DVKIITLKSNLVSNFRKEF KFYKVREINDY 986
WP_003041502    911 ED KAGFIKRQLVETRQITKHVAQILDERFNTEFDGAQRRIR--NVKIITLKSNLVSNFRKEF ELYKVREINDY 981
WP_037593752    911 ED KAGFIKRQLVETRQITKHVAQILDERFNTEFDGAQRRIR--NVKIITLKSNLVSNFRKEF ELYKVREINDY 981
WP_049516684    910 ED KAGFIKRQLVETRQITKHVAQILDRFNTEFDGAQRRIR---NVKIITLKSNLVSNFRKEF ELYKVREINDY 980
GAD46167        910 AD KAGFIKRQLVETRQITKHVAQILDARFNTERDENDKVIR--DVKVITLKSNLVSQFRKEF KFYKVRE_INDY 989
WP_018363470    919 AD KAGFIKRQLVETRQITKHVARILDSRMNTKRDKNDKPIR--EVKVITLKSKLVSDFRKDF QLYKVRDINNY 990
WP_003043819    920 ED KAGFIKRQLVETRQITKHVARILDSRMNTERDGNKERIR--NVKIITLKSNLVSNFRKEF ELYKVREINDY 990
WP_066269658    910 ED KAGFIKRQLVETRQITKHVAQILDERFNTEFDGNKERIR--NVKIITLKSNLVSNFRKEF ELYKVREINDY 980
WP_048800089    910 ND KAGFIHRQLVETRQITKHVAQILDARFNPKRDDNKKVIR--DVKIITLKSNLVSQFPRRDF KLYKVREINDY 980
WP_012767106    910 LD KAGFIKRQLVETRQITKHVAQILDSRMNTKYDENDKLIR--EVKVITLKSKLVSDFRKDF QFYKVREINHY 980
WP_014612333    910 LD KAGFIKRQLVETRQITKHVAQILDSRMNTKYDENDKLIR--EVKVITLKSKLVSDFRKDF QFYKVREINHY 980
WP_015017095    910 LD KAGFIKRQLVETRQITKHVAQILDSRMNTKYDENDKLIR--EVKVITLKSKLVSDFRKDF QFYKVREINDY 980
WP_015057649    910 LD KAGFIKRQLVETRQITKHVAQILDSRFNTEFDDHNKRIR--KVHIITLKSNLVSDFRKEF GLYKIRDINHY 980
WP_048327215    910 LD KAGFIKRQLVETRQITKHVAQILDSRFNTEFDDHNKRIR--KVHIITLKSNLVSDFRKEF GLYKIRDINHY 980
WP_049519324    910 LD KAGFIKRQLVETRQITKHVAQILDSRMNTKYDENDKLIR--EVKVITLKSKLVSDFRKDF QFYKVREINDY 980
WP_012515931    910 VD KAGFIQLQLVETRQITKHVAQILDARFNTKCDENDKVIR--DVKVITLKSSLVSQFRKEF KFYKVREINDY 980
WP_021320964    910 VD KAGFIKRQLVETRQITKHVAQILDSRFNTERDENDKVIR--DVKVITLKSNLVSQFPRKDF EFYKVREINDY 980
WP_037581760    910 VD KAGFIKRQLVETRQITKHVAQILDSRFNTERDENDKVIR--DVKVITLKSNLVSQFPRKDF EFYKVREINDY 980
WP_004232481    918 TD KAGFIKRQLVETRQITKHVARILDARFNTKCCDENDKVIR--DVKVITLKSSLVSLVSQFRKEF KFYKVREINDY 988
WP_009854540    919 AD KAGFIKRQLVETRQITKHVAQILDSRFNTEHDENDKVIR--DVKVITLKSNLVSQFPRKDF EFYKVREINDY 989
WP_012962174    919 ND KAGFIKRQLVETRQITKHVAQILDSRFNTERDENDKVIR--NVKVITLKSNLVSQFPRKDF KFYKVREINDY 989
```

-continued

```
WP_039695303    921 AD KAGFIKRQLVETRQITKHVAQILDARFNTEHDENDKVIR--DVKVITLKSNLVSQFRKDF EFYKVREINDY 991
WP_014334983    918 AD KAGFIKRQLVETRQITKHVAQILDARFNTKRDENDKVIR--DVKVITLKSNLVSQFRKEF KFYKLREVNDY 988
WP_003099269    911 FD KAGFIRRQLVETRQITKHVAQILDSRFNSNLTEDSKSNR--NVKIITLKSKMVSDFRKDF GFYKLREVNDY 981
AHY15608        911 FD KVGFIKRQLVETRQITKHVAQILDSRFNSNLTEDSKSNR--NVKIITLKSKMVSDFRKDF GFYKLREVNDY 981
AHY17476        911 FD KAGFIKRQLVETRQITKHVAQILDSRFNSNLTEDSKSNR--NVKIITLKSKMVSDFRKDF GFYKLREVNDY 981
ESR09100        --- -- ------------------------------------------------------- ----------- ---
AGM98575        911 FD KAGFIKRQLVETRQITKHVAQILDSRFNSNLTEDSKSNR--NVKIITLKSKMVSDFRKDF GFYKLREVNDY 981
ALF27331        911 DD KAGFIKRQLVETRQITKHVARILDERFNTETDENNKKIR--QVKIVTLKSNLVSNFRKEF ELYKVREINDY 981
WP_018372492    924 ED KAGFIRRQLVETRQITKHVARLLDEKLNRKKNENGEKLR--TTKIITLKSVFASRFRANF DLYKLRELNHY 994
WP_045618028    914 RD KAGFIKRQLVETRQITKHVAQILDARFNTEVTEKDKKDE--SVKIITLKSNLVSNFRKEF RLYKVREINDY 984
WP_045635197    913 RD KVGFIKRQLVETRQITKHVAQILDARYNTEVNEKDKKNR--TVKIITLKSNLVSNFRKEF RLYKVREINDY 983
WP_002263549    911 DD KAGFIKRQLVETRQITKHVARILDERFNTETDENNKKIR--QVKIVTLKSNLVSNFRKEF ELYKVREINDY 981
WP_002263887    911 DD KAGFIKRQLVETRQITKHVARILDERFNTETDENNKKIR--QVKIVTLKSNLVSNFRKEF ELYKVREINDY 981
WP_002264920    911 DD KAGFIKRQLVETRQITKHVARILDERFNTETDENNKKIR--QVKIVTLKSNLVSNFRKEF ELYKVREINDY 981
WP_002269043    911 DD KAGFIKRQLVETRQITKHVARILDERFNTETDENNKKIR--QVKIVTLKSNLVSNFRKEF ELYKVREINDY 981
WP_002269448    911 DD KAGFIKRQLVETRQITKHVARILDERFYTETDENNKKIR--QVKIVTLKSNLVSNFRKEF ELYKVREINDY 981
WP_002271977    911 DD KAGFIKRQLVETRQITKHVARILDERFYTETDENNKKIR--QVKIVTLKSNLVSNFRKEF ELYKVREINDY 981
WP_002272766    911 DD KAGFIKRQLVETRQITKHVARILDERFNTETDENNKKIR--QVKIVTLKSNLVSNFRKEF ELYKVREINDY 981
WP_002273241    911 DD KAGFIKRQLVETRQITKHVARILDERFNTETDENNKKIR--QVKIVTLKSNLVSNFRKEF ELYKVREINDY 981
WP_002275430    911 DD KAGFIKRQLVETRQITKHVARILDERFNTETDENNKKIR--QVKIVTLKSNLVSNFRKEF ELYKVREINDY 981
WP_002276448    911 DD KAGFIKRQLVETRQITKHVARMLDERFNKEFDDNNKKIR--RVKIVTLKSNLVSSFRKEF ELYKVREINDY 981
WP_002277050    913 DD KAGFIKRQLVETRQITKHVARILDERFHTETDENNKKIR--QVKIVTLKSNLVSNFRKEF ELYKVREINDY 983
WP_002277364    911 DD KAGFIKRQLVETRQITKHVARILDERFNTETDENNKKIR--QVKIVTLKSNLVSNFRKEF ELYKVREINDY 981
WP_002279025    911 DD KAGFIKRQLVETRQITKHVARILDERFHTETDENNKKIR--QVKIVTLKSNLVSNFRKEF ELYKVREINDY 981
WP_002279859    911 DD KAGFIKRQLVETRQITKHVARILDERFNTETDENNKKIR--QVKIVTLKSNLVSNFRKEF ELYKVREINDY 981
WP_002280230    911 DD KAGFIKRQLVETRQITKHVARILDERFYTETDENNKKIR--QVKIVTLKSNLVSNFRKEF ELYKVREINDY 981
WP_002281696    911 DD KAGFIKRQLVETRQITKHVARILDERFHTETDENNKKIR--QVKIVTLKSNLVSNFRKEF ELYKVREINDY 981
WP_002282247    913 DD KAGFIKRQLVETRQITKHVARILDERFNKEFDDNNKKIR--RVKIVTLKSNLVSSFRKEF ELYKVREINDY 983
WP_002282906    911 DD KAGFIKRQLVETRQITKHVARMLDERFNTETDENNKKIR--QVKIVTLKSNLVSNFRKEF ELYKVREINDY 981
WP_002283846    911 DD KAGFIKRQLVETRQITKHVARILDERFHTETDENNKKIR--QVKIVTLKSNLVSNFRKEF ELYKVREINDY 981
WP_002287255    911 DD KAGFIKRQLVETRQITKHVARILDERFHTETDENNKKIR--QVKIVTLKSNLVSNFRKEF ELYKVREINDY 981
WP_002288990    911 DD KAGFIKRQLVETRQITKHVARILDERFNTETDENNKKIR--QVKIVTLKSNLVSNFRKEF ELYKVREINDY 981
WP_002289641    911 DD KAGFIKRQLVETRQITKHVARILDERFNTETDENNKKIR--QVKIVTLKSNLVSNFRKEF ELYKVREINDY 981
WP_002290427    911 DD KAGFIKRQLVETRQITKHVARILDERFNTETDENNKKIR--QVKIVTLKSNLVSNFRKEF ELYKVREINDY 981
WP_002295753    911 DD KAGFIKRQHVETRQITKHVARILDERFYTETDENNKKIR--QVKIVTLKSNLVSNFRKEF ELYKVREINDY 981
WP_002296423    911 DD KAGFIKRQLVETRQITKHVARILDERFHTETDENNKKIR--QVKIVTLKSNLVSNFRKEF ELYKVREINDY 981
WP_002304487    925 DD KAGFIKRQLVETRQITKHVARILDERFHTETDENNKKIR--QVKIVTLKSNLVSNFRKEF ELYKVREINDY 995
WP_002305844    911 DD KAGFIKRQLVETRQITKHVARILDERFNTETDENNKKIR--QVKIVTLKSNLVSNFRKEF ELYKVREINDY 981
WP_002307203    911 DD KAGFIKRQLVETRQITKHVARILDERFNTETDENNKKIR--QVKIVTLKSNLVSNFRKEF ELYKVREINDY 981
WP_002310390    911 DD KAGFIKRQLVETRQITKHVARILDERFNTETDENNKKIR--QVKIVTLKSNLVSNFRKEF ELYKVREINDY 981
WP_002352408    911 DD KAGFIKRQLVETRQITKHVARILDERFHTETDENNKKIR--QVKIVTLKSNLVSNFRKEF ELYKVREINDY 981
WP_012997688    911 DD KAGFIKRQLVETRQITKHVARILDERFNTETDENNKKIR--QVKIVTLKSNLVSNFRKEF ELYKVREINDY 981
WP_014677909    911 DD KAGFIKRQLVETRQITKHVARILDERFYTETDENNKKIR--QVKIVTLKSNLVSNFRKEF ELYKVREINDY 981
WP_019312892    911 DD KAGFIKRQLVETRQITKHVARILDERFNTETDENNKKIR--QVKIVTLKSNLVSNFRKEF ELYKVREINDY 981
WP_019313659    911 DD KAGFIKRQLVETRQITKHVARILDERFNTETDENNKKIR--QVKIVTLKSNLVSNFRKEF ELYKVREINDY 981
WP_019314093    911 DD KAGFIKRQLVETRQITKHVARILDERFNTETDENNKKIR--QVKIVTLKSNLVSNFRKEF ELYKVREINDY 981
WP_019315370    911 DD KAGFIKRQLVETRQITKHVARILDERFNTETDENNKKIR--QVKIVTLKSNLVSNFRKEF ELYKVREINDY 981
WP_019803776    911 DD KAGFIKRQLVETRQITKHVARMLDERFNKEFDDNNKKIR--RVKIVTLKSNLVSSFRKEF ELYKVREINDY 981
WP_019805234    913 DD KAGFIKRQLVETRQITKHVARILDERFHTETDENNKKIR--QVKIVTLKSNLVSNFRKEF ELYKVREINDY 983
WP_024784288    911 DD KAGFIKRQLVETRQITKHVARILDERFNTETDENNKKIR--QVKIVTLKSNLVSNFRKEF ELYKVREINDY 981
WP_024784666    911 DD KAGFIKRQLVETRQITKHVARILDERFNTETDENNKKIR--QVKIVTLKSNLVSNFRKEF ELYKVREINDY 981
WP_024784894    911 DD KAGFIKRQLVETRQITKHVARILDERFNTETDENNKKIR--QVKIVTLKSNLVSNFRKEF ELYKVREINDY 981
```

```
                                     -continued

WP_024786433  913  DD  KAGFIKRQLVETRQITKHVARMLDERFNKEFDDNNKKIR--RVKIVTLKSNLVSSFRKEF  ELYKVREINDY  983
WP_049473442  911  DD  KAGFIKRQLVETRQITKHVARILDERFNTETDENNKKIR--QVKIVTLKSNLVSNFRKEF  ELYKVREINDY  981
WP_049474547  911  DD  KAGFIKRQLVETRQITKHVARILDERFNTETDENNKKIR--QVKIVTLKSNLVSNFRKEF  ELYKVREINDY  981
EMC03581      904  DD  KAGFIKRQLVETRQITKHVARILDERFHTETDENNKKIR--QVKIVTLKSNLVSNFRKEF  ELYKVREINDY  974
WP_000428612  916  RD  KVGFIKRQLVETRQITKHVAQILDARYNTEVNEKDKKNR--TVKIITLKSNLVSNFRKEF  RLYKIREINDY  986
WP_000428813  914  RD  KVGFIKRQLVETRQITKHVAQILDARFNKEVNEKDKKNR--TVKIITLKSNLVSNFRKEF  RLYKIREINDY  984
WP_049523028  909  RD  KVGFIKRQLVETRQITKHVAQILDDRFNAEVNEKNQKLR--SVKIITLKSNLVSNFRKEF  GLYKVREINDY  979
WP_003107102  880  YD  KAGFIKRQLVETRQITKHVAQILNNRFNNNVDDSSKNKR--PVKIITLKSKMVSDFRKEF  GFYKIREVNDY  950
WP_054279288  912  SD  KANFIQRQLVETRQITKHVAQILDSRFNTERDEKDRPIR--RVKVITLKSKFVSDFRQDF  GFYKLREINDY  982
WP_049531101  914  RD  KVGFIRRQLVETRQITKHVAQILDDRFNETKVNEKNQKIR--TVKIITLKSNLVSNFRKEF  RLYKVREINDY  984
WP_049538452  914  RD  KVGFIRRQLVETRQITKHVAQILDSRFNTEVNEKDKKNR--NVKIITLKSNLVSNFRKEF  ELYKVREINDY  984
WP_049549711  916  LD  KVGFIKRQLVETRQITKHVAQILDARFNKEVTEKDKKNR--NVKIITLKSNLVSNFRKEF  RLYKVREINDY  986
WP_007896501  917  SD  KARFLRRQLVETRQITKHVAQLLDSRFNSKSNQNKKLAR--NVKIITLKSKIVSDFRKDF  GLYKLREVNNY  987
EFR44625      869  SD  KARFLRRQLVETRQITKHVAQLLDSRFNSKSNQNKKLAR--NVKIITLKSKIVSDFRKDF  GLYKLREVNNY  939
WP_002897477  913  RD  KVGFIRRQLVETQQITKHVAQILDARFNTEVKEKNQKIR--TVKIITLKSNLVSNFRKEF  GLYKVREINDY  983
WP_002906454  913  RD  KVGFIKRQLVETRQITKHVAQLLDTRENTVENENQKIR--TVKIITLKSNLVSNFRKEF  GLYKVREINDY  983
WP_009729476  914  LD  KVGFIKRQLVETRQITKHVAQILDARFNKEVTEKDKKNR--TVKIITLKSNLVSNFRKEF  ELYKVREINDY  984
CQR24647      913  ED  KAGFIKRQLVETRQITKHVAQILDERFNRDFDKANDKLR--NVKIVTLKSNLVSNFRKEF  GFYKVREINNF  983
WP_000066813  918  LD  KVGFIRRQLVETRQITKHVAQFLDARFNMEVNEKDKKNR--NVKIITLKSNLVSNFRKEF  GLYKVREINDY  988
WP_009754323  914  RD  KVGFIKRQLVETRQITKHVAQILDARENTVSEKNQKIR--SVKIITLKSNLVSNFRKEF  KLYKVREINDY  984
WP_044674937  913  ED  KARFIQRQLVETRQITKHVAQILDARILDTRENTKLDEAGNRIRdpKVNIITLKSNLVSQFRKDY  QLYKVREINNY  985
WP_044676715  915  ED  KARFIQRQLVETRQITKHVAQILDARILDTRENTKLDEAGNRIRdpKVNIITLKSNLVSQFRKDY  QLYKVREINNY  987
WP_044680361  915  ED  KARFIQRQLVETRQITKHVAQILDARILDTRENTKLDEAGNRIRdpKVNIITLKSNLVSQFRKDY  QLYKVREINNY  987
WP_016681799  913  ED  KVGFIKRQLVETRQITKHVAQILDARILDTRENTKLDEAGNRIRdpKVNIITLKSNLVSQFRKDY  QLYKVREINNY  985
WP_049533112  910  ND  KAGFIKRQLVETRQITKHVAQVLDARFANKHDENKKVIR--DVKIITLKSNLVSQFRKDF  KFYKVREINDY  980
WP_029090905  891  RD  KEGFIARQLVETRQITKHVTQLLQQEY--------K--dTTKVFAIKATLVSGLRRKF  EFIKNRNVNDY  951
WP_065506696  917  ED  EERFINRQLVETRQITKNVTQIIEDHYST------------TKVAAIRANLSHEFRVKN  HIYKNRDINDY  976
AIT42264      911  LD  KAGFIKRQLVETRQITKHVAQILDSRMNTKYDENDKLIR--EVKVITLKSKLVSDERKDF  QFYKVREINNY  981
WP_034440723  915  RD  RQQFINRQLVETRQITKHVANLLSHHLNEK----KEVG--EINIVLLKSALTSQFRKKE  DFYKVREVNDY  980
AKQ21048      911  LD  KAGFIKRQLVETRQITKHVAQILDSRMNTKYDENDKLIR------R--INIVLLKSSMTSRFRKEF  KLYKVREINDY  981
WP_004636532  916  AD  RAHFLNRQLVETRQITKHVANLLDSQYNTAEEQ--------R--INIVLLKSSMTSRFRKEF  KLYKVREINDY  980
WP_002364836  922  ED  KAHFIQRQLVETRQITKHVAQILDQRYNANSKE----K--KVQIITLKASLTSQFRSIF  GLYKVREINDY  987
WP_016631044  873  ED  KAHFIQRQLVETRQITKHVAQILDQRYNAKSKE----K--KVQIITLKASLTSQFRSIF  GLYKVREVNDY  938
EMS75795      655  SK  KAHFIQRQLVETRQITKHVAAILDQYFN-QPEE-SK-NK--GIRIITLKSSLVSQFRKTF  GINKVREINNH  722
WP_002373311  922  ED  KAHFIQRQLVETRQITKHVAQILDQRYNAKSKE----K--KVQIITLKASLTSQFRSIF  GLYKVREVNDY  987
WP_002378009  922  ED  KAHFIQRQLVETRQITKHVAQILDQRYNAKSKE----K--KVQIITLKASLTSQFRSIF  GLYKVREVNDY  987
WP_002407324  922  ED  KAHFIQRQLVETRQITKHVAQILDQRYNANSKE----K--KVQIITLKASLTSQFRSIF  GLYKVREVNDY  987
WP_002413717  922  ED  KAHFIQRQLVETRQITKHVAQILDQRYNANSKE----K--KVQIITLKASLTSQFRSIF  GLYKVREVNDY  987
WP_010777580  924  ED  KAHFIQRQLVETRQITKHVAQILDQRYNAKSKE----K--KVQIITLKASLTSQFRSIF  GLYKVREVNDY  989
WP_010818269  922  ED  KAHFIQRQLVETRQITKHVAQILDQRYNAKSKE----K--KVQIITLKASLTSQFRSIF  GLYKVREVNDY  987
WP_010824395  922  ED  KAHFIQRQLVETRQITKHVAQILDLYNAKSKE----K--KVQIITLKASLTSQFRSIF  GLYKVREVNDY  987
WP_016622645  922  ED  KAHFIQRQLVETRQITKHVAQILDQRYNAKSKE----K--KVQIITLKASLTSQFRSIF  GLYKVREVNDY  987
WP_033624816  922  ED  KAHFIQRQLVETRQITKHVAQILDQRYNAKSKE----K--KVQIITLKASLTSQFRSIF  GLYKVREVNDY  987
WP_032625576  922  ED  KAHFIQRQLVETRQITKHVAQILDQRYNAKSKE----K--KVQIITLKASLTSQFRSIF  GLYKVREVNDY  987
WP_337789179  922  ED  KAHFIQRQLVETRQITKHVAQILDQRYNAKSKE----K--KVQIITLKASLTSQFRSIF  GLYKVREVNDY  987
WP_002310644  919  ED  KAHFIQRQLVETRQITKHVAQILHHREN-KAEDTNEPIR--KVRIITLKSALVSQFRNRF  GIYKVREINEY  988
WP_002312694  920  ED  KAHFIQRQLVETRQITKHVAQILHHREN-KAEDTNDPIR--KVRIITLKSALVSQFRNRF  GIYKVREINEY  989
WP_002314015  920  ED  KAHFIQRQLVETRQITKHVAQILHHREN-KAEDTNEPIR--KVRIITLKSALVSQFRNRF  GIYKVREINEY  989
WP_002320716  920  ED  KAHFIQRQLVETRQITKHVAQILHHREN-KAEDTNEPIR--KVRIITLKSALVSQFRNRF  GIYKVREINEY  989
WP_002330729  919  ED  KAHFIQRQLVETRQITKHVAQILHHREN-KAEDTNEPIR--KVRIITLKSALVSQFRNRF  GIYKVREINEY  988
WP_002335161  920  ED  KAHFIQRQLVETRQITKHVAQILHHREN-KAEDTNEPIR--KVRIITLKSALVSQFRNRF  GIYKVREINEY  989
WP_002345439  920  ED  KAHFIQRQLVETRQITKHVAQILHHREN-KAEDTNEPIR--KVRIITLKSALVSQFRNRF  GIYKVREINEY  989
WP_034867970  911  ED  KARFIQRQLVETRQITKHVANILHQSFN-QEEEGTD-CD--GVQIITLKATLTSQFRQTF  GLYKVREINPH  979
```

-continued

```
WP_047937432  920 ED KAGFIKRQLVETRQITKHVAGILHHRFN-KAEDTNEPIR--KVRIITLKSALVSQFRNRF GIYKVREINEY 989
WP_010720994  911 ED KARFIQRQLVETRQITKHVANILHQSFN-QEEEGTD-CD--GVQIITLKATLTSQFRQTF GLYKVREINPH 979
WP_010737004  911 ED KARFIQRQLVETRQITKHVANILHQSFN-QEEEGTD-CD--GVQIITLKATLTSQFRQTF GLYKVREINPH 979
WP_034700478  911 ED KAGFLKRQLVETRQITKHVATILDSKFNE--DSNNRDVQ----IITLKSALVSEFRKTF NLYKVREINDL 979
WP_007209003  912 SD KARFIQRQLVETRQITKHVANLLHQHFN-LPEEVSA-TE--KTSIITLKSTLTSQFRQMF DIYKVREINHH 977
WP_023519017  905 DD RAHFIKRQLVETRQITKHVARILDQRFNSQKDEEGKTIR--AVRVVTLKSSLTSQFRKQF AIHKVREINDY 973
WP_010770040  915 DD KARFIHRQLVETRQITKHVARILHQRFNSEKDEEGNLIR--KVRIITLKSALTSQFRKNY GIYKVREINDY 985
WP_048604708  912 DD KARFIHRQLVETRQITKHVAAILHQYFN-QTQELEK-EK--DIRIITLKSSLVSQFRQVF GIHKVREINHH 982
WP_010750235  914 DD KARFIQRQLVETRQITKHVAQILDSRMNTKYDENDKLIR--EVKVITLKSKLVSDERKDF QFYKVREINNY 982
AII16583      950 LD KAGFIKRQLVETRQITKHVAQILDSRMNTKYDENDKLIR--EVKVITLKSKLVSDERKDF QFYKVREINNY 1020
WP_029073316  928 KD KERFINRQIVETRQITKHVAQIISNHYET---------TKVVTVRADLSHAFRERY HIYKNRDINDF 987
WP_031589969  928 KD QERFINRQIVETRQITKHVAQIIDDNHYEN--------TKVVTVRADLSHQFRERY HIYQNRDINDF 987
KDA45870      903 KL KERFIERQLVETRQITKYVAQLLDQRLN-YDNGVELD-eKIAIVTLKAQLASQFRSEF KLRKVRALNNL 972
WP_039099354  924 -D MKGFINRQLVETRQVIKLATNLLMEQYGED-------NIELITVKSGLTHQMRTEF DFPKNRNLANHH 990
AKP02966      926 KD KLGFIHRQLVQTSQMVKGVANILNSMYK--NQGTTCIQ-----ARANLSTAFRKAL ELVKNRNINDF 999
WP_010991369  914 AD KARFIHRQLVETRQITKHVANILHQRFNYEKDHGNTMK--QVRIVTLKSALVSQFRKQF QLYKVREVNDY 984
WP_033838504  914 AD KARFIHRQLVETRQITKNVANILHQRFNYEKDHGNTMK--QVRIVTLKSALVSQFRKQF QLYKVRDVNDY 984
EHN60060      917 AD KARFIHRQLVETRQITKNVANILHQRFNYEKDHGNTMK--QVRIVTLKSALVSQFRKQF QLYKVRDVNDY 987
EFR89594      683 AD KARFIHRQLVETRQITKNVANILYQRFNCKQDENGNEVE--QVRIVTLKSTLVSQFRKQF QLYKVRGVNDY 753
WP_038409211  914 AD KANFIQRQLVETRQITKNVANILYQRFNCKQDENGNEVE--QVRIVTLKSTLVSQFRKQF QLYKVREVNDY 984
EFR95520      533 AD KARFIHRQLVETRQITKNVANILYQRFNCKQDENGNEVE--QVRIVTLKSTLVSQFRKQF QLYKVREVNDY 603
WP_003723650  914 AD KARFIHRQLVETRQITKNVANILYQRFNKETDNHGNTME--QVRIVTLKSALVSQFRKQF QLYKVREVNGY 984
WP_003727705  914 AD KARFIHRQLVETRQITKNVANILYQRFNKETDNHGNTME--QVRIVTLKSALVSQFRKQF QLYKVREVNDY 984
WP_003730785  914 AD KARFIHRQLVETRQITKNVANILHQRFNKETDNHGNTME--QVRIVTLKSALVSQFRKQF QLYKVREVNDY 984
WP_003733029  914 AD KARFIHRQLVETRQITKNVANILHQRFNYKTDGNKDTME--TVRIVTLKSALVSQFRKQF QLYKVREVNDY 984
WP_003739838  914 AD KATFIHRQLVETRQITKNVANILHQRFNFNETDNHGNNME--QVRIVMLKSALVSQFRKQF QLYKVREVNDY 984
WP_014601172  914 AD KARFIHRQLVETRQITKNVANILHQRFNNETDNHGNTME--PVRIVTLKSALVSQFRKQF QLYKVREVNDY 984
WP_023548323  914 AD KARFIHRQLVETRQITKNVANILHQRFNNETDNHGNTME--PVRIVTLKSALVSQFRKQF QLYKVREVNDY 984
WP_031665337  914 AD KARFIHRQLVETRQITKNVANILHQRFNKETDNHGNTME--TVRIVTLKSALVSQFRKQF QLYKVREVNDY 984
WP_031669209  914 AD KARFIHRQLVETRQITKNVANILHQRFNYKTDGNKDTME--TVRIVTLKSALVSQFRKQF QFYKVREVNDY 984
WP_033920898  917 AD KARFIHRQLVETRQITKNVANILHQRFNNETDNHGNTME--PVRIVTLKSALVSQFRKQF QLYKVREVNDY 987
AKI42028      917 AD KARFIHRQLVETRQITKNVANILHQRFNNETDNHGNTME--QVRIVTLKSALVSQFRKQF QLYKVREVNDY 987
AKI50529      362 AD KARFIHRQLVETRQITKNVANILHQRFNNETDNHGNTME--QVRIVTLKSALVSQFRKQF QLYKVREVNDY 432
EFR83390      914 AD KARFIHRQLVETRQITKNVANILHQRFNCKKDESGNVIE--QVRIVTLKAALVSQFRKQF QLYKVREVNDY 984
WP_046323366  927 LD KARFIQRQLVETRQITKHVAQILDSRMNLKYDENDKLIR--EVKVITLKSKLVSDFRKDF QFYKVREINNY 997
AKE81011      921 RD EERFINRQLVETRQITKNVTQIIEDHYST--------TKVAAIRANLSHEFRVKN HIYKNRDINDY 980
CUO82355      923 KD KERFINRQLVETRQITKNVAVIINDHYTN--------TNIVTVRAELSHQFRERY KIYKNRDINDF 982
WP_033162887  944 LD KAGFIKRQLVETRQITKHVAQILDSRMNTKYDENDKLIR--EVKVITLKSKLVSDFRKDF QFYKVREINNY 1014
AGZ01981      911 LD KAGFIKRQLVETRQITKHVAQILDSRMNTKYDENDKLIR--EVKVITLKSKLVSDFRKDF QFYKVREINNY 981
AKA60242      911 LD KAGFIKRQLVETRQITKHVAQILDSRMNTKYDENDKLIR--EVKVITLKSKLVSDFRKDF QFYKVREINNY 981
AKS40380      915 LD KAGFIKRQLVETRQITKHVAQILDSRMNTKYDENDKLIR--EVKVITLKSKLVSDFRKDF QFYKVREINNY 985
4UN5_B        982 HHAHDAYLNAVGTALIKKYPKL-ESEFVYGDYKVYDV S---EQEi--GK ATAKY--F-FYSNIM-NFFKTEIT 1051
WP_010922251  992 HHAHDAYLNAVGTALLKKYPKL-ASEFVYGEYKKYDI S---SD---KATAK--YfFYSNLM-NFFKTKVK 1058
WP_039695303  984 HHAHDAYLNAVVAKAILKKYPKL-EPEFVYGEYQKYDL SkdpKEV--EK ATEKY--F-FYSNLL-NFFKEEVH 1055
WP_045635197  703 HHAEDALI------IaNADPIFKEWNKLDK Nq-mFE---EK ETEQEYkEiFITPHQiKHIKDFKD 771
5AXW_A        666 HHAEDAYLNAVGTALIKKYPKL-ESEFVYGDYKVYDI S---EQEi--GK ATAKY--F-FYSNIM-NFFKTEIT 735
WP_009880683  982 HHAHDAYLNAVGTALIKKYPKL-ESEFVYGDYKVYDI S---EQEi--GK ATAKY--F-FYSNIM-NFFKTEIT 1051
WP_010922251  982 HHAHDAYLNAVGTALIKKYPKL-ESEFVYGDYKVYDI S---EQEi--GK ATAKY--F-FYSNIM-NFFKTEIT 1051
WP_010054416  982 HHAHDAYLNAVGTALIKKYPKL-ESEFVYGDYKVYDI S---EQEi--GK ATAKY--F-FYSNIM-NFFKTEIT 1051
WP_011284745  982 HHAHDAYLNAVGTALIKKYPKL-ESEFVYGDYKVYDI S---EQEi--GK ATAKY--F-FYSNIM-NFFKTEIT 1051
WP_011285506  982 HHAHDAYLNAVGTALIKKYPKL-ESEFVYGDYKVYDI S---EQEi--GK ATAKY--F-FYSNIM-NFFKTEIT 1051
WP_011527619  982 HHAHDAYLNAVGTALIKKYPKL-ESEFVYGDYKVYDI S---EQEi--GK ATAKY--F-FYSNIM-NFFKTEIT 1051
WP_012560673  982 HHAHDAYLNAVGTALIKKYPKL-ESEFVYGDYKVYDI S---EQEi--GK ATAKY--F-FYSNIM-NFFKTEIT 1051
```

-continued

| | | | | |
|---|---|---|---|---|
| WP_014407541 | 981 | HHAHDAYLNAVVGTALIKKYPKL-ESEFVYGDYKVYDV | S---EQEi--GK ATAKY--F-FYSNIM-NFFKTEIT | 1050 |
| WP_020905136 | 982 | HHAHDAYLNAVVGTALIKKYPKL-ESEFVYGDYKVYDV | S---EQEi--GK ATAKY--F-FYSNIM-NFFKTEIT | 1051 |
| WP_023080005 | 981 | HHAHDAYLNAVVGTALIKKYPKL-ESEFVYGDYKVYDV | S---EQEi--GK ATAKY--F-FYSNIM-NFFKTEIT | 1050 |
| WP_023610282 | 982 | HHAHDAYLNAVVGTALIKKYPKL-ESEFVYGDYKVYDV | S---EQEi--GK ATAKY--F-FYSNIM-NFFKTEIT | 1051 |
| WP_030125963 | 981 | HHAHDAYLNAVVGTALIKKYPKL-ESEFVYGDYKVYDV | S---EQEi--GK ATAKY--F-FYSNIM-NFFKTEIT | 1050 |
| WP_030126706 | 982 | HHAHDAYLNAVVGTALIKKYPKL-ESEFVYGDYKVYDV | S---EQEi--GK ATAKY--F-FYSNIM-NFFKTEIT | 1051 |
| WP_031488318 | 982 | HHAHDAYLNAVVGTALIKKYPKL-ESEFVYGDYKVYDV | S---EQEi--GK ATAKY--F-FYSNIM-NFFKTEIT | 1051 |
| WP_032460140 | 982 | HHAHDAYLNAVVGTALIKKYPKL-ESEFVYGDYKVYDV | S---EQEi--GK ATAKY--F-FYSNIM-NFFKTEIT | 1051 |
| WP_032461047 | 982 | HHAHDAYLNAVVGTALIKKYPKL-ESEFVYGDYKVYDI | S---EQEi--GK ATAKY--F-FYSNIM-NFFKTEIT | 1051 |
| WP_032462016 | 982 | HHAHDAYLNAVVGTALIKKYPKL-ESEFVYGDYKVYDV | S---EQEi--GK ATAKY--F-FYSNIM-NFFKTEIT | 1051 |
| WP_032462936 | 982 | HHAHDAYLNAVVGTALIKKYPKL-ESEFVYGDYKVYDV | S---EQEi--GK ATAKY--F-FYSNIM-NFFKTEIT | 1051 |
| WP_032464890 | 982 | HHAHDAYLNAVVGTALIKKYPKL-ESEFVYGDYKVYDV | S---EQEi--GK ATAKY--F-FYSNIM-NFFKTEIT | 1051 |
| WP_033888930 | 807 | HHAHDAYLNAVVGTALIKKYPKL-ESEFVYGDYKVYDV | S---EQEi--GK ATAKY--F-FYSNIM-NFFKTEIT | 876 |
| WP_038431314 | 982 | HHAHDAYLNAVVGTALIKKYPKL-ESEFVYGDYKVYDV | S---EQEi--GK ATAKY--F-FYSNIM-NFFKTEIT | 1051 |
| WP_038432938 | 981 | HHAHDAYLNAVVGTALIKKYPKL-ESEFVYGDYKVYDV | S---EQEi--GK ATAKY--F-FYSNIM-NFFKTEIT | 1050 |
| WP_038434062 | 982 | HHAHDAYLNAVVGTALIKKYPKL-ESEFVYGDYKVYDV | S---EQEi--GK ATAKY--F-FYSNIM-NFFKTEIT | 1051 |
| BAQ51233 | 893 | HHAHDAYLNAVVGTALIKKYPKL-ESEFVYGDYKVYDV | S---EQEi--GK ATAKY--F-FYSNIM-NFFKTEIT | 962 |
| KGE60162 | 157 | HHAHDAYLNAVVGTALIKKYPKL-ESEFVYGDYKVYDV | S---EQEi--GK ATAKY--F-FYSNIM-NFFKTEIT | 226 |
| KGE60856 | | | | |
| WP_002989955 | 982 | HHAHDAYLNAVVGTALIKKYPKL-ESEFVYGDYKVYDV | S---EQEi--GK ATAKY--F-FYSNIM-NFFKTEIT | 1051 |
| WP_003030002 | 981 | HHAHDAYLNAVVGNALLLKKYPQL-EPEFVYGEYPKYN | S---YR---sRK SATEK-F1FYSNIL-RFFKKE-- | 1041 |
| WP_003065552 | 992 | HHAHDAYLNAVVGTALIKKYPKL-ASEFVYGEYKKYDI | S---SD----- KATAK-YfFYSNLM-NFFKRVIR | 1058 |
| WP_001040076 | 987 | HHAHDAYLNAVVAKAILTKYPQL-EPEFVYGDYPKYN | L---SKI---VR ATRKM-F-FYSNLM-NMFKRVVR | 1057 |
| WP_001040078 | 987 | HHAHDAYLNAVVAKAILTKYPQL-EPEFVYGDYPKYN | S---YKT---RK ATEKL-F-FYSNIM-NFFKTKVT | 1049 |
| WP_001040080 | 987 | HHAHDAYLNAVVAKAILTKYPQL-EPEFVYGDYPKYN | S---YKT---RK ATEKL-F-FYSNIM-NFFKTKVT | 1049 |
| WP_001040081 | 987 | HHAHDAYLNAVVAKAILTKYPQL-EPEFVYGDYPKYN | S---YKT---RK ATEKL-F-FYSNIM-NFFKTKVT | 1049 |
| WP_001040083 | 987 | HHAHDAYLNAVVAKAILTKYPQL-EPEFVYGDYPKYN | S---YKT---RK ATEKL-F-FYSNIM-NFFKTKVT | 1049 |
| WP_001040085 | 987 | HHAHDAYLNAVVAKAILTKYPQL-EPEFVYGDYPKYN | S---YKT---RK ATEKL-F-FYSNIM-NFFKTKVT | 1049 |
| WP_001040087 | 987 | HHAHDAYLNAVVAKAILTKYPQL-EPEFVYGDYPKYN | S---YKT---RK ATEKL-F-FYSNIM-NFFKTKVT | 1049 |
| WP_001040088 | 987 | HHAHDAYLNAVVAKAILTKYPQL-EPEFVYGDYPKYN | S---YKT---RK ATEKL-F-FYSNIM-NFFKTKVT | 1049 |
| WP_001040089 | 987 | HHAHDAYLNAVVAKAILTKYPQL-EPEFVYGDYPKYN | S---YKT---RK ATEKL-F-FYSNIM-NFFKTKVT | 1049 |
| WP_001040090 | 987 | HHAHDAYLNAVVAKAILTKYPQL-EPEFVYGDYPKYN | S---YKT---RK ATEKL-F-FYSNIM-NFFKTKVT | 1049 |
| WP_001040091 | 987 | HHAHDAYLNAVVAKAILTKYPQL-EPEFVYGDYPKYN | S---YKT---RK ATEKL-F-FYSNIM-NFFKTKVT | 1049 |
| WP_001040092 | 987 | HHAHDAYLNAVVAKAILTKYPQL-EPEFVYGDYPKYN | S---YKT---RK ATEKL-F-FYSNIM-NFFKTKVT | 1049 |
| WP_001040094 | 987 | HHAHDAYLNAVVAKAILTKYPQL-EPEFVYGDYPKYN | S---YKT---RK ATEKL-F-FYSNIM-NFFKTKVT | 1049 |
| WP_001040095 | 987 | HHAHDAYLNAVVAKAILTKYPQL-EPEFVYGDYPKYN | S---YKT---RK ATEKL-F-FYSNIM-NFFKTKVT | 1049 |
| WP_001040096 | 987 | HHAHDAYLNAVVAKAILTKYPQL-EPEFVYGDYPKYN | S---YKT---RK ATEKL-F-FYSNIM-NFFKTKVT | 1049 |
| WP_001040097 | 987 | HHAHDAYLNAVVAKAILTKYPQL-EREFVYGDYPKYN | S---YKT---RK ATEKL-F-FYSNIM-NFFKTKVT | 1049 |
| WP_001040098 | 987 | HHAHDAYLNAVVAKAILTKYPQL-EPEFVYGDYPKYN | S---YKT---RK ATEKL-F-FYSNIM-NFFKTKVT | 1049 |
| WP_001040099 | 987 | HHAHDAYLNAVVAKAILTKYPQL-EPEFVYGDYPKYN | S---YKT---RK ATEKL-F-FYSNIM-NFFKTKVT | 1049 |
| WP_001040100 | 987 | HHAHDAYLNAVVAKAILTKYPQL-EPEFVYGDYPKYN | S---YKT---RK ATEKL-F-FYSNIM-NFFKTKVT | 1049 |
| WP_001040104 | 987 | HHAHDAYLNAVVAKAILTKYPQL-EPEFVYGDYPKYN | S---YKT---RK ATEKL-F-FYSNIM-NFFKTKVT | 1049 |
| WP_001040105 | 987 | HHAHDAYLNAVVAKAILTKYPQL-EPEFVYGDYPKYN | S---YKT---RK ATEKL-F-FYSNIM-NFFKTKVT | 1049 |
| WP_001040106 | 987 | HHAHDAYLNAVVAKAILTKYPQL-EPEFVYGDYPKYN | S---YKT---RK ATEKL-F-FYSNIM-NFFKTKVT | 1049 |
| WP_001040107 | 987 | HHAHDAYLNAVVAKAILTKYPQL-EPEFVYGDYPKYN | S---YKT---RK ATEKL-F-FYSNIM-NFFKTKVT | 1049 |
| WP_001040108 | 987 | HHAHDAYLNAVVAKAILTKYPQL-EPEFVYGDYPKYN | S---YKT---RK ATEKL-F-FYSNIM-NFFKTKVT | 1049 |
| WP_001040109 | 987 | HHAHDAYLNAVVAKAILTKYPQL-EPEFVYGDYPKYN | S---YKT---RK ATEKL-F-FYSNIM-NFFKTKVT | 1049 |
| WP_001040110 | 987 | HHAHDAYLNAVVAKAILTKYPQL-EPEFVYGDYPKYN | S---YKT---RK ATEKL-F-FYSNIM-NFFKTKVT | 1049 |
| WP_015058523 | 987 | HHAHDAYLNAVVAKAILTKYPQL-EPEFVYGDYPKYN | S---YKT---RK ATEKL-F-FYSNIM-NFFKTKVT | 1049 |
| WP_017643650 | 987 | HHAHDAYLNAVVAKAILTKYPQL-EPEFVYGDYPKYN | S---YKT---RK ATEKL-F-FYSNIM-NFFKTKVT | 1049 |
| WP_017647151 | 987 | HHAHDAYLNAVVAKAILTKYPQL-EPEFVYGDYPKYN | S---YKT---RK ATEKL-F-FYSNIM-NFFKTKVT | 1049 |
| WP_017648376 | 987 | HHAHDAYLNAVVAKAILTKYPQL-EPEFVYGDYPKYN | S---YKT---RK ATEKL-F-FYSNIM-NFFKTKVT | 1049 |
| WP_017649527 | 987 | HHAHDAYLNAVVAKAILTKYPQL-EPEFVYGDYPKYN | S---YKT---RK ATEKL-F-FYSNIM-NFFKTKVT | 1049 |

-continued

```
WP_017771611   987  HHAHDAYLNAVLNAVVAKAILTKYPQL-EPEFVYGDYPKYN-  S---YKT---RK  ATEKL--F-FYSNIM-NFFKTKVT  1049
WP_017771984   987  HHAHDAYLNAVLNAVVAKAILTKYPQL-EPEFVYGDYPKYN-  S---YKT---RK  ATEKL--F-FYSNIM-NFFKTKVT  1049
CFQ25032       987  HHAHDAYLNAVLNAVVAKAILTKYPQL-EPEFVYGDYPKYN-  S---YKT---RK  ATEKL--F-FYSNIM-NFFKTKVT  1049
CFV16040       987  HHAHDAYLNAVLNAVVAKAILTKYPQL-EPEFVYGDYPKYN-  S---YKT---RK  ATEKL--F-FYSNIM-NFFKTKVT  1049
KLJ37842       987  HHAHDAYLNAVLNAVVAKAILTKYPQL-EPEFVYGDYPKYN-  S---YKT---RK  ATEKL--F-FYSNIM-NFFKTKVT  1049
KLJ72361       987  HHAHDAYLNAVLNAVVAKAILTKYPQL-EPEFVYGDYPKYN-  S---YKT---RK  ATEKL--F-FYSNIM-NFFKTKVT  1049
KLL20707      1001  HHAHDAYLNAVLNAVVAKAILTKYPQL-EPEFVYGDYPKYN-  S---YKT---RK  ATEKL--F-FYSNIM-NFFKTKVT  1063
KLL42645       987  HHAHDAYLNAVLNAVVAKAILTKYPQL-EPEFVYGDYPKYN-  S---YKT---RK  ATEKL--F-FYSNIM-NFFKTKVT  1049
WP_047207273   987  HHAHDAYLNAVLNAVVAKAILTKYPQL-EPEFVYGDYPKYN-  S---YKT---RK  ATEKL--F-FYSNIM-NFFKTKVT  1049
WP_047209694   987  HHAHDAYLNAVLNAVVAKAILTKYPQL-EPEFVYGDYPKYN-  S---YKT---RK  ATEKL--F-FYSNIM-NFFKTKVT  1049
WP_050198062   987  HHAHDAYLNAVLNAVVAKAILTKYPQL-EPEFVYGDYPKYN-  S---YKT---RK  ATEKL--F-FYSNIM-NFFKTKVT  1049
WP_050201642   987  HHAHDAYLNAVLNAVVAKAILTKYPQL-EPEFVYGDYPKYN-  S---YKT---RK  ATEKL--F-FYSNIM-NFFKTKVT  1049
WP_050204027   987  HHAHDAYLNAVLNAVVAKAILTKYPQL-EPEFVYGDYPKYN-  S---YKT---RK  ATEKL--F-FYSNIM-NFFKTKVT  1049
WP_050881965   987  HHAHDAYLNAVLNAVVAKAILTKYPQL-EPEFVYGDYPKYN-  S---YKT---RK  ATEKL--F-FYSNIM-NFFKTKVT  1049
WP_050886065   987  HHAHDAYLNAVLNAVVAKAILTKYPQL-EPEFVYGDYPKYN-  S---YKT---RK  ATEKL--F-FYSNIM-NFFKTKVT  1049
AHN30376       987  HHAHDAYLNAVLNAVVAKAILTKYPQL-EPEFVYGDYPKYN-  S---YKT---RK  ATEKL--F-FYSNIM-NFFKTKVT  1049
EA078426       987  HHAHDAYLNAVLNAVVAKAILTKYPQL-EPEFVYGDYPKYN-  S---YKT---RK  ATEKL--F-FYSNIM-NFFKTKVT  1049
CCW42055       981  HHAHDAYLNAVLNAVIGTALLKKYPKL-ASEFVYGEFKKYDV  S---DK---eIG  KATAK--YfFYSNLM-NFFKKEVK  1050
WP_003041502   982  HHAHDAYLNAVVGNALLLKYPKL-EPEFVYGDYPKYN-      S---RK---sRK  SATEK--F1FYSNIL-RFFKKE--  1042
WP_037593752   982  HHAHDAYLNAVVGNALLLKYPKL-EPEFVYGDYPKYN-      S---YR---sRK  SATEK--F1FYSNIL-RFFKKE--  1041
WP_049516684   981  HHAHDAYLNAVVGNALLLKYPKL-EPEFVYGEYPKYN-      S---YR---sRK  SATEK--F1FYSNIL-RFFKKE--  1041
GAD46167       990  HHAHDAYLNAVVGTALLKKYPKL-APEFVYGEKKKYDV      S---SDDhseMG  KATAK--YfFYSNLM-NFFKRVIR  1062
WP_018363470   991  HHAHDAYLNAVVGTALLKKYPKL-ESEFVYGDYKVYDV      S---EQEi--GK  ATAKR--F-FYSNLM-NFFKTEVK  1060
WP_003043819   981  HHAHDAYLNAVVGTALLKKYPKL-EPEFVYGEYPKYN-      S---YR---sRK  SATEK--F1FYSNIL-RFFKKE--  1041
WP_006269658   981  HHAHDAYLNAVVGTALLKKYPKL-TSEFVYGEYKKYDV      S---DND---eIG  KATAK--YfFYSNLM-NFFKTEVK  1051
WP_048800889   981  HHAHDAYLNAVVGTALLKKYPKL-ESEFVYGDYKVYDV      S---EQEi--GK  ATAKR--F-FYSNLM-NFFKTEIT  1050
WP_012767106   981  HHAHDAYLNAVVGTALLKKYPKL-ESEFVYGEYQKYDV      S---EQEi--GK  ATAKR--F-FYSNLM-NFFKTEIT  1050
WP_014612333   981  HHAHDAYLNAVVGTALLKKYPKL-ESEFVYGDYKVYDV      S---EQEi--GK  ATAKR--F-FYSNLM-NFFKTEIT  1050
WP_015017095   981  HHAHDAYLNAVVGTALLKKYPKL-ESEFVYGDYKVYDV      S---EQEi--GK  ATAKR--F-FYSNLM-NFFKTEVK  1050
WP_015057649   981  HHAHDAYLNAVVGTALLKKYPKL-ESEFVYGDYKVYDV      S---EQEi--GK  ATAKR--F-FYSNLM-NFFKTEIT  1050
WP_048327215   981  HHAHDAYLNAVVGTALLKKYPKL-ESEFVYGDYKVYDV      S---EQEi--GK  ATAKR--F-FYSNLM-NFFKTEIT  1050
WP_049519324   981  HHAHDAYLNAVVGTALLKKYPKL-APEFVYGDYPKYN-      S---FKEr--QK  ATQKM--L-FYSNIL-KFFKDQES  1043
WP_012515931   981  HHAHDAYLNAVVAKAILGKYPKL-APEFVYGDYPKYN-      S---FKEr--QK  ATQKT--L-FYSNIL-KFFKDQES  1043
WP_021320964   989  HHAHDAYLNAVVAKAILGKYPKL-APEFVYGDYPKYN-      S---FKEr--QK  ATQKT--L-FYSNIL-KFFKDQES  1061
WP_037581760   990  HHAHDAYLNAVVGTALLKKYPKL-APEFVYGEYKKKYD      S---SDNhseLG  KATAK--YfFYSNIL-NFFKTEVK  1056
WP_009854540   990  HHAHDAYLNAVVAKAILKYPKL-APEFVYGEYKKYDV       S---SD---     KATAK--YfFYSNLL-NFFKEEVH  1056
WP_012962174   992  HHAHDAYLNAVVGTALLKKYPKL-APEFVYGEYKKYDI      S---GD---     KATAK--YfFYSNLM-NFFKRVIR  1058
WP_039695303   989  HHAHDAYLNAVVGTALLKKYPKL-ASEFVYGEYKKYDI      S---SD---     KATAK--YfFYSNLM-NFFKTKVK  1061
WP_014334983   989  HHAHDAYLNAVVGTALLKKYPKL-TPEFVYGEYKKYDV      S---SDDyseMG  KATAK--YfFYSNLM-NFFKTEVK  1061
WP_003099269   982  HHAQDAYLNAVVGTALLKKYPKL-ESEFVYGDYKHYDL      P---DSSi--GK  ATTRM--F-FYSNLM-NFFKKEIK  1051
AHY15608       982  HHAQDAYLNAVVGTALLKKYPKL-EAEFVYGDYKHYDL      P---DSSi--GK  ATTRM--F-FYSNLM-NFFKKEIK  1051
AHY17476       982  HHAQDAYLNAVVGTALLKKYPKL-EAEFVYGDYKHYDL      P---DSSi--GK  ATTRM--F-FYSNLM-NFFKKEIK  1051
ESR09100
AGM98575       982  HHAQDAYLNAVVGTALLKKYPKL-EAEFVYGDYKHYDL      P---DSSi--GK  ATTRM--F-FYSNIM-NFFKKEIK  1051
ALF27331       982  HHAHDAYLNAVIGKALLGVYPQL-EPEFVYGDYPHFH-      G---HK----eNK  ATAKK--F-FYSNIM-NFFKKD--  1041
WP_018372492   995  HHAHDAYLNAVVGTALLKVYPKP-ERELVYGSYVKESI      G---FS---RK   ATERM--rMNNIL--KFISKD--  1055
WP_045618028   985  HHAHPYLNAVVAKAILKVYPKP-EPEFVYGDYQKYDL       TkdpKEV--EK   ATEKY--F-FYSNLL-NFFKEEVH  1056
WP_045635197   984  HHAHDAYLNAVVAKAILGVYPQL-EPEFVYGEYQKYDL      SkdpKEV--EK   ATEKY--F-FYSNLL-NFFKEEVH  1055
WP_012962549   982  HHAHDAYLNAVIGKALLGVYPQL-EPEFVYGDYPHFH-      G---HK----eNK  ATAKK--F-FYSNIM-NFFKKD--  1041
WP_002263887   982  HHAHDAYLNAVIGKALLGVYPQL-EPEFVYGDYPHFH-      G---HK----eNK  ATAKK--F-FYSNIM-NFFKKD--  1041
WP_002264920   982  HHAHDAYLNAVIGKALLGVYPQL-EPEFVYGDYPHFH-      G---HK----eNK  ATAKK--F-FYSNIM-NFFKKD--  1041
WP_002269043   982  HHAHDAYLNAVIGKALLGVYPQL-EPEFVYGDYPHFH-      G---HK----eNK  ATAKK--F-FYSNIM-NFFKKD--  1041
```

-continued

| | | | | | |
|---|---|---|---|---|---|
| WP_002269448 | 982 | HHAHDAYLNAVIGKALLGVYPQL-EPEFVYGDYPHFH | G---HK----eNK | ATAKK--F-FYSNIM-NFFKKD-- | 1041 |
| WP_002271977 | 982 | HHAHDAYLNAVIGKALLGVYPQL-EPEFVYGDYPHFH | G---HK----eNK | ATAKK--F-FYSNIM-NFFKKD-- | 1041 |
| WP_002272766 | 982 | HHAHDAYLNAVIGKALLGVYPQL-EPEFVYGDYPHFH | G---HE----eNK | ATAKK--F-FYSNIM-NFFKKD-- | 1041 |
| WP_002273241 | 982 | HHAHDAYLNAVIGKALLGVYPQL-EPEFVYGDYPHFH | G---HK----eNK | ATAKK--F-FYSNIM-NFFKKD-- | 1041 |
| WP_002275430 | 982 | HHAHDAYLNAVIGKALLGVYPQL-EPEFVYGDYPHFH | G---HE----eNK | ATAKK--F-FYSNIM-NFFKKD-- | 1041 |
| WP_002276448 | 982 | HHAHDAYLNAVIGKALLGVYPQL-EPEFVYGDYPHFH | G---HK----eNK | ATAKK--F-FYSNIM-NFFKKD-- | 1041 |
| WP_002277050 | 984 | HHAHDAYLNAVVKALLVKYPKL-EPEFVYGEYPKYN | S---YR----eRK | ATQKM--F-FYSNIM-NMFKSKVK | 1046 |
| WP_002277364 | 982 | HHAHDAYLNAVIGKALLGVYPQL-EPEFVYGDYPHFH | G---HK----eNK | ATAKK--F-FYSNIM-NFFKKD-- | 1041 |
| WP_002279025 | 982 | HHAHDAYLNAVIGKALLGVYPQL-EPEFVYGDYPHFH | G---HE----eNK | ATAKK--F-FYSNIM-NFFKKD-- | 1041 |
| WP_002279859 | 982 | HHAHDAYLNAVIGKALLGVYPQL-EPEFVYGDYPHFH | G---HK----eNK | ATAKK--F-FYSNIM-NFFKKD-- | 1041 |
| WP_002280230 | 982 | HHAHDAYLNAVIGKALLGVYPQL-EPEFVYGDYPHFH | G---HK----eNK | ATAKK--F-FYSNIM-NFFKKD-- | 1041 |
| WP_002281696 | 984 | HHAHDAYLNAVIGKALLVKYPKL-EPEFVYGEYPKYN | S---YR----eRK | ATQKM--F-FYSNIM-NMFKSKVK | 1046 |
| WP_002282247 | 982 | HHAHDAYLNAVIGKALLGVYPQL-EPEFVYGDYPHFH | G---HK----eNK | ATAKK--F-FYSNIM-NFFKKD-- | 1041 |
| WP_002282906 | 982 | HHAHDAYLNAVIGKALLGVYPQL-EPEFVYGDYPHFH | G---HK----eNK | ATAKK--F-FYSNIM-NFFKKD-- | 1041 |
| WP_002283846 | 982 | HHAHDAYLNAVIGKALLGVYPQL-EPEFVYGDYPHFH | G---HE----eNK | ATAKK--F-FYSNIM-NFFKKD-- | 1041 |
| WP_002287255 | 982 | HHTHDAYLNAVIGKALLGVYPQL-EPEFVYGDYPHFH | G---HK----eNK | ATAKK--F-FYSNIM-NFFKKD-- | 1041 |
| WP_002288990 | 982 | HHAHDAYLNAVIGKALLGVYPQL-EPEFVYGDYPHFH | G---HK----eNK | ATAKK--F-FYSNIM-NFFKKD-- | 1041 |
| WP_002289641 | 982 | HHAHDAYLNAVIGKALLGVYPQL-EPEFVYGDYPHFH | G---HK----eNK | ATAKK--F-FYSNIM-NFFKKD-- | 1041 |
| WP_002290427 | 982 | HHAHDAYLNAVIGKALLGVYPQL-EPEFVYGDYPHFH | G---HK----eNK | ATAKK--F-FYSNIM-NFFKKD-- | 1041 |
| WP_002295753 | 982 | HHAHDAYLNAVIGKALLGVYPQL-EPEFVYGDYPHFH | G---HK----eNK | ATAKK--F-FYSNIM-NFFKKD-- | 1041 |
| WP_002296423 | 982 | HHAHDAYLNAVIGKALLGVYPQL-EPEFVYGDYPHFH | G---HK----eNK | ATAKK--F-FYSNIM-NFFKKD-- | 1041 |
| WP_002304487 | 996 | HHAHDAYLNAVIGKALLGVYPQL-EPEFVYGDYPHFH | G---HK----eNK | ATAKK--F-FYSNIM-NFFKKG-- | 1055 |
| WP_002305844 | 982 | HHAHDAYLNAVIGKALLGVYPQL-EPEFVYGDYPHFH | G---HK----eNK | ATAKK--F-FYSNIM-NFFKKD-- | 1041 |
| WP_002307203 | 982 | HHAHDAYLNAVIGKALLGVYPQL-EPEFVYGDYPHFH | G---HK----eNK | ATAKK--F-FYSNIM-NFFKKD-- | 1041 |
| WP_002310390 | 982 | HHAHDAYLNAVIGKALLGVYPQL-EPEFVYGDYPHFH | G---HK----eNK | ATAKK--F-FYSNIM-NFFKKD-- | 1041 |
| WP_002352408 | 982 | HHAHDAYLNAVIGKALLGVYPQL-EPEFVYGDYPHFH | G---HK----eNK | ATAKK--F-FYSNIM-NFFKKD-- | 1041 |
| WP_012997688 | 984 | HHAHDAYLNAVVKALLVKYPKL-EPEFVYGEYPKYN | S---YR----eRK | ATQKM--F-FYSNIM-NMFKSKVK | 1046 |
| WP_014677909 | 982 | HHAHDAYLNAVIGKALLGVYPQL-EPEFVYGDYPHFH | G---HK----eNK | ATAKK--F-FYSNIM-NFFKKD-- | 1041 |
| WP_019312892 | 982 | HHAHDAYLNAVIGKALLGVYPQL-EPEFVYGDYPHFH | G---HK----eNK | ATAKK--F-FYSNIM-NFFKKD-- | 1041 |
| WP_019313659 | 982 | HHAHDAYLNAVIGKALLGVYPQL-EPEFVYGDYPHFH | G---HK----eNK | ATAKK--F-FYSNIM-NFFKKD-- | 1041 |
| WP_019314093 | 982 | HHAHDAYLNAVIGKALLGVYPQL-EPEFVYGDYPHFH | G---HE----eNK | ATAKK--F-FYSNIM-NFFKKD-- | 1041 |
| WP_019315370 | 982 | HHAHDAYLNAVIGKALLGVYPQL-EPEFVYGDYPHFH | G---HK----eNK | ATAKK--F-FYSNIM-NFFKKD-- | 1041 |
| WP_019803776 | 982 | HHAHDAYLNAVIGKALLGVYPQL-EPEFVYGDYPHFH | G---HK----eNK | ATAKK--F-FYSNIM-NFFKKD-- | 1041 |
| WP_019805234 | 982 | HHAHDAYLNAVIGKALLGVYPQL-EPEFVYGDYPHFH | G---HK----eNK | ATAKK--F-FYSNIM-NFFKKD-- | 1041 |
| WP_024783594 | 982 | HHAHDAYLNAVIGKALLGVYPQL-EPEFVYGDYPHFH | G---HK----eNK | ATAKK--F-FYSNIM-NFFKKD-- | 1041 |
| WP_024784288 | 984 | HHAHDAYLNAVVKALLVKYPKL-EPEFVYGEYLKYN | S---YR----eRK | ATQKM--F-FYSNIM-NMFKSKVK | 1046 |
| WP_024784666 | 982 | HHAHDAYLNAVIGKALLGVYPQL-EPEFVYGDYPHFH | G---HK----eNK | ATAKK--F-FYSNIM-NFFKKD-- | 1041 |
| WP_024784894 | 982 | HHAHDAYLNAVIGKALLGVYPQL-EPEFVYGDYPHFH | G---HK----eNK | ATAKK--F-FYSNIM-NFFKKD-- | 1041 |
| WP_024786433 | 984 | HHAHDAYLNAVVKALLVKYPKL-EPEFVYGEYPKYN | S---YR----eRK | ATQKM--F-FYSNIM-NMFKSKVK | 1046 |
| WP_049473442 | 982 | HHAHDAYLNAVIGKALLGVYPQL-EPEFVYGDYPHFH | G---HE----eNK | ATAKK--F-FYSNIM-NFFKKD-- | 1041 |
| WP_049474547 | 982 | HHAHDAYLNAVIGKALLGVYPQL-EPEFVYGDYPHFH | G---HK----eNK | ATAKK--F-FYSNIM-NFFKKD-- | 1041 |
| EMC03581 | 975 | HHAHDAYLNAVIGKALLGVYPQL-EPEFVYGDYPHFH | G---HK----eNK | ATAKK--F-FYSNIM-NFFKKD-- | 1034 |
| WP_000428612 | 987 | HHAHDAYLNAVAKAILKKYPKL-EPEFVYGDYQKYDL | SkdpKEI-EK | ATEKY--F-FYSNLL-NFFKEEVH | 1058 |
| WP_000428613 | 985 | HHAHDAYLNAVAKAILKKYPKL-EPEFVYGDYQKYDL | SrmpKEV-EK | ATEKY--F-FYSNLL-NFFKEEVH | 1056 |
| WP_049523028 | 980 | HHAHDAYLNAVAKAILKKYPKL-EPEFVYGDYQKYDL | TkdpKEI-EK | ATEKY--F-FYSNLL-NFFKDKVY | 1051 |
| WP_003107102 | 951 | HHAHDAYLNAVGTALLKKYPKL-EAEFVYGDYKHYDL | S---DTS1-GK | ATAKM--F-FYSNIM-NFFKKEVR | 1020 |
| WP_054279288 | 983 | HHAHDAYLNAVGTALLKMYPKL-ASEFVYGDYQKYDL | S---GKAs-GH | ATAKY--F-FYSNLL-NFFKSEVK | 1052 |
| WP_049531101 | 985 | HHAHDAYLNAVAKAILKKYPKL-EPEFVYGDYQKYDL | SrdpKEI-EK | ATEKY--F-FYSNLL-NFFKEEVH | 1056 |
| WP_049538452 | 985 | HHAHDAYLNAVAKAILKKYPKL-EPEFVYGDYQKYDL | SkdpKDI-EK | ATEKY--F-FYSNLL-NFFKEEVH | 1056 |
| WP_049549711 | 987 | HHAHDAYLNAVAKAILKKYPKL-EPEFVYGDYQKNDL | SkdpKDI-EK | ATEKY--F-FYSNLL-NFFKEEVH | 1058 |
| WP_007896501 | 988 | HHAHDAYLNAVGTALLKKYPKL-EAEFVYGDYKHFDL | S---DPS1-GK | ATAKV--F-FYSNIM-NFFKEELS | 1057 |
| EFR44625 | 940 | HHAHDAYLNAVGTALLKKYPKL-EAEFVYGDYKHFDL | S---DPS1-GK | ATAKV--F-FYSNIM-NFFKEELS | 1009 |
| WP_002897477 | 984 | HHAHDAYLNAVVAKAILKKYPKL-EPEFVYGDYQKYDL | FkpsKEI-EK | ATEKY--F-FYSNLL-NFFKEEVL | 1055 |

```
WP_002906454   984  HHAHDAYLNAVVAKAILKKYPKL-EPEFVYGDYQKYDL SkasNTI---DK ATEKY--F-FYSNLL-NFFKEKVR    1055
WP_009729476   985  HHAHDAYLNAVVAKAILKKYPKL-EPEFVYGDYQKYDL SkdpKEI---EK ATEKY--F-FYSNLL-NFFKEEVH    1056
CQR24647       984  HHAHDAYLNAVVAKALLIRYPKL-EPEFVYGEYPKYN- S---YRE---RK ATEKM--F-FYSNIM-NMFKTTIK    1046
WP_000666813   989  HHAHDAYLNAVLAKAILKKYPKL-EPEFVYGEYPKYN- srepKEV---EK ATQKY--F-FYSNIL-NFFKEEVH    1060
WP_009754323   985  HHAHDAYLNAVVAKAILKKYPQL-APEFVYGDYQKYDL SkdpKEV---EK ATEKY--F-FYSNIL-NFFKEEVH    1056
WP_044674937   986  HHAHDAYLNAVVATALLKKYPKL-APEFVYGDYPKYN- S---YKS---RK ATEKV--L-FYSNIM-NFFRRVLV    1048
WP_044676715   988  HHAHDAYLNAVVATALLKKYPKL-APEFVYGDYPKYN- S---YKS---RK ATEKV--L-FYSNIM-NFFRRVLV    1050
WP_044680361   986  HHAHDAYLNAVVATALLKKYPQL-APEFVYGDYPKYN- S---YKS---RK ATEKV--L-FYSNIM-NFFRRVLV    1048
WP_044681799   988  HHAHDAYLNAVVATALLKKYPQL-APEFVYGDYPKYN- S---YKS---RK ATEKV--L-FYSNIM-NFFRRVLV    1050
WP_049533112   981  HHAHDAYLNAVIGTALLKKYPKL-ASEFVYGEFKKYDV S--DK--eIG KATAK--YfFYSNLM-NFFKKEVK      1050
WP_029090905   952  HHAQDAFLVAFLGTNITSNYPKI-EMEYLFKGYQHYLN ---Ev--GK AAKPKftF-IVENLS-----------     1007
WP_006506696   977  HHAHQDAYIVALIGGFMRDRYPNMhDSKAVYSEYMKMFR -----NKNd--QK ----g---FVINSM-NYPY-EV-   1038
AIT42264       982  HHAHDAYLNAVVGTALIKKYPKL-ESEFVYGDYKVYDV S---EQEi--GK ATAKY--F-FYSNIM-NFFKTEIT    1051
WP_034440723   981  HHAHDAYLNGVIALKLELYPYM-AKDLIYGKYSYHRK G---------DK ATQAK--Y-KMSNII-ERFSQDL-    1041
AKQ21048       982  HHGHDAYLNAVVATTIMKVYPNL-KPQFVYGQYKKTSM S---EQEi--GK ATAKY--F-FYSNIM-NFFKKEKV    1051
WP_004636532   981  HHGQDAYLNCVVATTLLKVYPNL-APEFVYGEYPKFQT ----FKE---EK ATARK--H-FYSNII-RFFTED--   1047
WP_002364836   988  HHGQDAYLNCVVATTLLKVYPNL-APEFVYGEYPKFQT ----FKE---NK ATAKA--I-IYTNLL-RFFTED--   1047
WP_016631044   939  HHGQDAYLNCVVATTLLKVYPNL-APEFVYGEYPKFQT ----FKE---NK ATAKA--I-IYTNLL-RFFTED--    998
EMS75795       723  HHAHDAYLNGVAIALLKKYPKL-EPEFVYGNYTKFNL  ----AT---eNK ATAKK--E-FYSNIL-RFFBEKE     782
WP_002373311   988  HHGQDAYLNCVVATTLLKVYPNL-APEFVYGEYPKFQA ----FKE---NK ATAKT--I-IYTNLM-RFFTED--   1047
WP_002378009   988  HHGQDAYLNCVVATTLLKVYPNL-APEFVYGEYPKFQT ----FKE---NK ATAKA--I-IYTNLL-RFFTED--   1047
WP_002407324   988  HHGQDAYLNCVVATTLLKVYPNL-APEFVYGEYPKFQT ----FKE---NK ATAKA--I-IYTNLL-RFFTED--   1047
WP_002413717   988  HHGQDAYLNCVVATTLLKVYPNL-APEFVYGEYPKFQT ----FKE---NK ATAKA--I-IYTNLL-RFFTED--   1047
WP_010775580   990  HHGQDAYLNCVVATTLLKVYPNL-APEFVYGEYPKFQT ----FKE---NK ATAKA--I-IYTNLL-RFFTED--   1049
WP_010818269   988  HHGQDAYLNCVVATTLLKVYPNL-APEFVYGEYPKFQT ----FKE---NK ATAKA--I-IYTNLL-RFFTED--   1047
WP_010824395   988  HHGQDAYLNCVVATTLLKVYPNL-APEFVYGEYPKFQT ----FKE---NK ATAKA--I-IYTNLL-RFFTED--   1047
WP_016622645   988  HHGQDAYLNCVVATTLLKVYPNL-APEFVYGEYPKFQA ----FKE---NK AMAKA--I-IYTNLL-RFFTED--   1047
WP_033624816   988  HHGQDAYLNCVVATTLLKVYPNL-APEFVYGEYPKFQA ----FKE---NK ATAKA--I-IYTNLL-RFFTED--   1047
WP_033625576   988  HHGQDAYLNCVVATTLLKVYPNL-APEFVYGEYPKFQA ----FKE---NK ATAKA--I-IYTNLM-RFFTEV--   1047
WP_033789179   988  HHGQDAYLNCVVATTLLKVYPNL-APEFVYGEYPKFQA ----FKE---NK ATAKA--I-IYTNLM-RFFTED--   1047
WP_002310644   989  HHAHDAYLNGVALALLKKYPNL-APEFVYGEYLKFNA  ----HK---aNK ATVKK--E-FYSNIM-KFFESD--   1048
WP_002312694   990  HHAHDAYLNGVALALLKKYPQL-APEFVYGEYLKFNA  ----HK---aNK ATVKK--E-FYSNIM-KFFESD--   1049
WP_002314015   990  HHAHDAYLNGVALALLKKYPQL-APEFVYGEYLKFNA  ----HK---aNK ATVKK--E-FYSNIM-KFFESD--   1049
WP_002320716   990  HHAHDAYLNGVALALLKKYPQL-APEFVYGEYLKFNA  ----HK---aNK ATVKK--E-FYSNIM-KFFESD--   1049
WP_002330729   989  HHAHDAYLNGVALALLKKYPQL-APEFVYGEYLKFNA  ----HK---aNK ATVKK--E-FYSNIM-KFFESD--   1048
WP_002335161   990  HHAHDAYLNGVALALLKKYPQL-APEFVYGEYLKFNA  ----HK---aNK ATVKK--E-FYSNIM-KFFESD--   1049
WP_002345439   990  HHAHDAYLNGVALALLKKYPQL-APEFVYGEYLKFNA  ----HK---aNK ATVKK--E-FYSNIM-KFFESD--   1049
WP_034867970   980  HHAHDAYLNGFIANVLLKRYPNL-APEFVYGKVVKYSL ----AR---eNK ATAKK--E-FYSNIL-KFLESD--   1039
WP_047937432   990  HHAHDAYLNGVIALALLKKYPNL-APEFVYGEYLKFNA ----HK---aNK ATVKK--E-FYSNIM-KFFESD--   1049
WP_010720994   980  HHAHDAYLNGFIANVLLKRYPNL-APEFVYGKVVKYSL ----AR---eNK ATAKK--E-FYSNIL-KFLESD--   1039
WP_010737004   980  HHAHDAYLNGFIANVLLKRYPNL-APEFVYGKVVKYSL ----AR---eNK ATAKK--E-FYSNIL-KFLESD--   1039
WP_034700478   980  HHAHDAYLNGFIANVLLKRYPNL-APEFVYGKVVKYSL ----AR---eNK ATAKK--E-FYSNIL-KFLESD--   1039
WP_007209003   978  HHAHDAYLNAVVALSLLRVYPQL-KPEFVYGSYIKGDI ----IHDq--NK ATIKK--E-FYSNIT-RYFASK-    1037
WP_023590917   974  HHAHDAYLNGVAMTLLKKYPKL-APEFVYGSYIKGDI ----NQ----iNK ATAKK--E-FYSNIM-KFFAED--   1033
WP_010770040   986  HHGHDAYLNGVVANSLLRVYPQL-QPEFVYGDYPKFNA ----YKA--NK ATAKK--Q-LYTNIM-KFFAED--    1045
WP_048604708   983  HHAHDAYLNGVVATALLKIYPQL-EPEFVYGEFHRFNA ----FKE---NK ATAKK--Q-FYSNLM-EFSKSD-    1042
WP_010750235   983  HHAHDAYLNAVALALLKKYPRL-APEFVYGSFAKFHL  ----VK---eNK ATAKK--F-FYSNIL-KFFEKE-    1042
AII16583      1021  HHAHDAYIATILGTYIGHRFESL-ESEFVYGDYKVYDV S---EQEi--GK ATAKY--F-FYSNIM-NFFKTEIT   1090
WP_029073316   988  HHAHDAYIATILGTYIGHRFESL-DAKYIYGEYQKIFR ----NKNk--DK ---KDg--F-FILNSM-RNLYADK-  1052
WP_031589969   988  HHAHDAYIATILGTYIGHRFESL-DAKYIYGEYKRIFR ----QKNk--GK ---NDg--F-FILNSM-RNIYADK-  1052
KDA45870       973  HHAHDAYLNAVVANLIMAKYPEL-EPEFVYGKYRTK-  ----FKG1--GK ATAKN----RN--F---NFL-NGLKKD---  1034
WP_039099354   991  HHAFDAYLTAFVGLYLYLKRYPKL-KPYPVYGEYQKAS ----QQ---DK ----RN--F---NFL-NGLKKD------  1043
AKP02966      1000  HHAQDAYLASFLGTYRLRRFPTD-EMLLMNGEYNKFYG -----KElysKK -SRKN-gF-IISPLV-----------  1062
```

-continued

```
WP_010991369    985  HHAHDAYLNGVVANTLLKVYPQL-EPEFVYGDYHQFDW ----FKA---NK ATAKK--Q-FYTNIM LFFAQK--  1044
WP_033838504    985  HHAHDAYLNGVVANTLLKVYPQL-EPEFVYGDYHQFDW ----FKA---NK ATAKK--Q-FYTNIM LFFAQK--  1044
EHN60060        988  HHAHDAYLNGVVANTLLKVYPQL-EPEFVYGDYHQFDW ----FKA---NK ATAKK--Q-FYTNIM LFFAQK--  1047
EFR89594        754  HHAHDAYLNGVVANTLLKVYPQL-EPEFVYGDYHQFDW ----FKA---NK ATAKK--Q-FYTNIM LFFAQK--  813
WP_038409211    985  HHAHDAYLNGVVANTLLKVYPQL-EPEFVYGDYHQFDW ----FKA---NK ATAKK--Q-FYTNIM RFFAQK--  1044
EFR95520        604  HHAHDAYLNGVVANTLLKVYPQL-EPEFVYGDYHQFDW ----FKA---NK ATAKK--Q-FYTNIM RFFAKE--  663
WP_003723650    985  HHAHDAYLNGVVANTLLKVYPQL-EPEFVYGDYHQFDW ----FKA---NK ATAKK--Q-FYTNIM LFFAQK--  1044
WP_003727705    985  HHAHDAYLNGVVANTLLKVYPQL-EPEFVYGDYHQFDW ----FKA---NK ATAKK--Q-FYTNIM LFFAQK--  1044
WP_003730785    985  HHAHDAYLNGVVANTLLKVYPQL-EPEFVYGDYHQFGW ----FKA---NK ATAKK--Q-FYTNIM LFFAQK--  1044
WP_003733029    985  HHAHDAYLNGVVANTLLKVYPQL-EPEFVYGEYHQFDW ----FKA---NK ATAKK--Q-FYTNIM LFFAQK--  1044
WP_003739838    985  HHAHDAYLNGVVANTLLKVYPQL-EPEFVYGEYHQFDW ----FKA---NK ATAKK--Q-FYTNIM LFFAQK--  1044
WP_014601172    985  HHAHDAYLNGVVANTLLKVYPQL-EPEFVYGEYHQFDW ----FKA---NK ATAKK--Q-FYTNIM LFFAQK--  1044
WP_023548323    985  HHAHDAYLNGVVANTLLKVYPQL-EPEFVYGEYHQFDW ----FKA---NK ATAKK--Q-FYTNIM LFFGQK--  1044
WP_031665337    985  HHAHDAYLNGVVANTLLKVYPQL-EPEFVYGEYHQFDW ----FKA---NK ATAKK--Q-FYTNIM LFFAQK--  1044
WP_031669209    985  HHAHDAYLNGVVANTLLKVYPQL-EPEFVYGEYHQFDW ----FKA---NK ATAKK--Q-FYTNIM LFFAQK--  1044
WP_033920898    985  HHAHDAYLNGVVANTLLKVYPQL-EPEFVYGEYHQFDW ----FKA---NK ATAKK--Q-FYTNIM LFFAQK--  1044
AKI42028        988  HHAHDAYLNGVVANTLLKVYPQL-EPEFVYGEYHQFDW ----FKA---NK ATAKK--Q-FYTNIM LFFAQK--  1047
AKI50529        988  HHAHDAYLNGVVANTLLKVYPQL-EPEFVYGEYHQFDW ----FKA---NK ATAKK--Q-FYTNIM LFFGQK--  1047
EFR83390        433  HHAHDAYLNCVVANTLLKVYPQL-EPEFVYGEYHQFDW ----FKA---NK ATAKK--Q-FYTNIM LFFAKK--  492
WP_046323366    985  HHAHDAYLNAVVANTLLKVYPKL-ESEFVYGDYKVYDV S---EQEi-GK ATAKY--F-FYSNIM NFFKTEIT  1044
AKE81011        998  HHAHDAYIVALIGGFMRDRYPNMhDSKAVYSEYMKMFR ----NKNd--QK -------g---FVINSM-NYPY-EV-  1067
CUO82355        981  HHAHDAYIACIVGQFMHQNFEHL-DAKIIYGQYK---- ----------KNy---KK---NTg----FILNSM-NHLQSDI-  1042
AGZ01981       1015  HHAHDAYLNAVVGTALIKKYPKL-ESEFVYGDYKVYDV S---EQEi-GK ATAKY--F-FYSNIM NFFKTEIT  1084
AKA60242        982  HHAHDAYLNAVVGTALIKKYPKL-ESEFVYGDYKVYDV S---EQEi-GK ATAKY--F-FYSNIM NFFKTEIT  1051
AK540380        982  HHAHDAYLNAVVGTALIKKYPKL-ESEFVYGDYKVYDV S---EQEi-GK ATAKY--F-FYSNIM NFFKTEIT  1051
4UN5_B          986  HHAHDAYLNAVVGTALIKKYPKL-ESEFVYGDYKVYDV S---EQEi-GK ATAKY--F-FYSNIM NFFKTEIT  1055
WP_010922251   1052  LAN-GEIRKRPLIE-TNGET-GE-IWDKGRDFATVRKVLS-MPQVNIVKKTEVQT GGFSK ESIL-PKR-  1114
WP_039695303   1059  YAD-GTVFERPIIE T-NAD-GE-IAWNKQIDPEKVRKVLS-YPQVNIVKKVETQT GGFSK ESIL-PKG-  1120
WP_045635197   1056  YAD-GTIVKRENIE Y-SKDLGE-IAWNKEKDFAIIKKVLS-LPQVNIVKKREVQT GGFSK ESIL-PKG-  1118
5AXW_A          772  YKYsHRVDKKPNRE VNNLN-GL---YDKDND--KLKKLINkSPEKLLMYHHDPQT --YQK KLIMeQYGd  852
WP_009880683    736  TNGET-GE-IWDKGRDFATVRKVLS-MPQVNIVKKTEVQT GGFSK ESIL-PKR-  798
WP_010922251   1052  LAN-GEIRKRPLIE TNGET-GE-IWDKGRDFATVRKVLS-MPQVNIVKKTEVQT GGFSK ESIL-PKR-  1114
WP_011054416   1052  LAN-GEIRKRPLIE TNGET-GE-IWDKGRDFATVRKVLS-MPQVNIVKKTEVQT GGFSK ESIL-PKR-  1114
WP_011284745   1052  LAN-GEIRKRPLIE TNGET-GE-IWDKGRDFATVRKVLS-MPQVNIVKKTEVQT GGFSK ESIL-PKR-  1114
WP_011285506   1052  LAN-GEIRKRPLIE TNGET-GE-IWDKGRDFATVRKVLS-MPQVNIVKKTEVQT GGFSK ESIL-PKR-  1114
WP_011527619   1052  LAN-GEIRKRPLIE TNGET-GE-IWDKGRDFATVRKVLS-MPQVNIVKKTEVQT GGFSK ESIL-PKR-  1114
WP_012560673   1051  LAN-GEIRKRPLIE TNGET-GE-IWDKGRDFATVRKVLS-MPQVNIVKKTEVQT GGFSK ESIL-PKR-  1113
WP_014407541   1052  LAN-GEIRKRPLIE TNGET-GE-IWDKGRDFATVRKVLS-MPQVNIVKKTEVQT GGFSK ESIL-PKR-  1114
WP_020905136   1052  LAN-GEIRKRPLIE TNGET-GE-IWDKGRDFATVRKVLS-MPQVNIVKKTEVQT GGFSK ESIL-PKR-  1114
WP_023080005   1051  LAN-GEIRKRPLIE TNGET-GE-IWDKGRDFATVRKVLS-MPQVNIVKKTEVQT GGFSK ESIL-PKR-  1113
WP_023610282   1051  LAN-GEIRKRPLIE TNGET-GE-IWDKGRDFATVRKVLS-MPQVNIVKKTEVQT GGFSK ESIL-PKR-  1113
WP_030125963   1052  LAN-GEIRKRPLIE TNGET-GE-IWDKGRDFATVRKVLS-MPQVNIVKKTEVQT GGFSK ESIL-PKR-  1114
WP_030126706   1052  LAN-GEIRKRPLIE TNGET-GE-IWDKGRDFATVRKVLS-MPQVNIVKKTEVQT GGFSK ESIL-PKR-  1114
WP_031488318   1052  LAN-GEIRKRPLIE TNGET-GE-IWDKGRDFATVRKVLS-MPQVNIVKKTEVQT GGFSK ESIL-PKR-  1114
WP_032460140   1052  LAN-GEIRKRPLIE TNGET-GE-IWDKGRDFATVRKVLS-MPQVNIVKKTEVQT GGFSK ESIL-PKR-  1114
WP_032461047   1052  LAN-GEIRKRPLIE TNGET-GE-IWDKGRDFATVRKVLS-MPQVNIVKKTEVQT GGFSK ESIL-PKR-  1114
WP_032462016   1052  LAN-GEIRKRPLIE TNGET-GE-IWDKGRDFATVRKVLS-MPQVNIVKKTEVQT GGFSK ESIL-PKR-  1114
WP_032462936   1052  LAN-GEIRKRPLIE TNGET-GE-IWDKGRDFATVRKVLS-MPQVNIVKKTEVQT GGFSK ESIL-PKR-  1114
WP_032464890   1052  LAN-GEIRKRPLIE TNGET-GE-IWDKGRDFATVRKVLS-MPQVNIVKKTEVQT GGFSK ESIL-PKR-  1114
WP_033888930    877  LAN-GEIRKRPLIE TNGET-GE-IWDKGRDFATVRKVLS-MPQVNIVKKTEVQT GGFSK ESIL-PKR-  939
WP_038431314   1052  LAN-GEIRKRPLIE TNGET-GE-IWDKGRDFATVRKVLS-MPQVNIVKKTEVQT GGFSK ESIL-PKR-  1114
WP_038432938   1051  LAN-GEIRKRPLIE TNGET-GE-IWDKGRDFATVRKVLS-MPQVNIVKKTEVQT GGFSK ESIL-PKR-  1113
```

-continued

```
WP_038434062    1052 LAN-GEIRKRPLIE TNGET-GE-IWDKGRDFATVRKVLS-MPQVNIVKKTEVQT GGFSK ESIL-PKR- 1114
BAQ51233         963 LAN-GEIRKRPLIE TNGET-GE-IWDKGRDFATVRKVLS-MPQVNIVKKTEVQT GGFSK ESIL-PKR- 1025
KGE60162         227 LAN-GEIRKRPLIE TNGET-GE-IWDKGRDFATVRKVLS-MPQVNIVKKTEVQT GGFSK ESIL-PKR-  289
KGE60856           1 ------------IE --------IE-IWDKGRDFATVRKVLS-MPQVNIVKKTEVQT GGFSK ESIL-PKR-   52
WP_002989955    1052 LAN-GEIRKRPLIE TNGET-GE-IWDKGRDFATVRKVLS-MPQVNIVKKTEEQT GGFSK ESIL-PKR- 1114
WP_003030002    1042 ------------DIQ T-NED-GE-IAWNKEKHIKILRKVLS-YPQVNIVKKTEEQT GGFSK ESIL-PKG- 1093
WP_003065552    1059 YSN-GKVIVRPVVE Y-SKD-TEdIAWDKKKSNERTICKVLS-YPQVNIVKKVETQT GGFSK ESIL-PKG- 1121
WP_001040076    1050 LAD-GTVVVKDDIE VNNDT-GE-IWDKKKKHFATVRKVLS-YPQVNIVKKTEIQT GGFSK ESIL-AHG- 1112
WP_001040078    1058 LAD-GSIVVRPVIE TGRYM-GK-TAWDKKKKHFATVRKVLS-YPQVNIVKKTEIQT GGFSK ESIL-AHG- 1120
WP_001040080    1050 LAD-GTVVVKDDIE VNNDT-GE-IWDKKKKHFATVRKVLS-YPQNNIVKKTEIQT GGFSK ESIL-AHG- 1112
WP_001040081    1050 LAD-GTVVVKDDIE VNNDT-GE-IWDKKKKHFATVRKVLS-YPQNNIVKKTEIQT GGFSK ESIL-AHG- 1112
WP_001040083    1050 LAD-GTVVVKDDIE VNNDT-GE-IWDKKKKHFATVRKVLS-YPQNNIVKKTEIQT GGFSK ESIL-AHG- 1112
WP_001040085    1050 LAD-GTVVVKDDIE VNNDT-GE-IWDKKKKHFATVRKVLS-YPQNNIVKKTEIQT GGFSK ESIL-AHG- 1112
WP_001040087    1050 LAD-GTVVVKDDIE VNNDT-GE-IWDKKKKHFATVRKVLS-YPQVNIVKKTEIQT GGFSK ESIL-AHG- 1112
WP_001040088    1050 LAD-GTVVVKDDIE VNNDT-GE-IWDKKKKHFATVRKVLS-YPQNNIVKKTEIQT GGFSK ESIL-AHG- 1112
WP_001040089    1050 LAD-GTVVVKDDIE VNNDT-GE-IWDKKKKHFATVRKVLS-YPQNNIVKKTEIQT GGFSK ESIL-AHG- 1112
WP_001040090    1050 LAD-GTVVVKDDIE VNNDT-GE-IWDKKKKHFATVRKVLS-YPQVNIVKKTEIQT GGFSK ESIL-AHG- 1112
WP_001040091    1050 LAD-GTVVVKDDIE VNNDT-GE-IWDKKKKHFATVRKVLS-YPQVNIVKKTEIQT GGFSK ESIL-AHG- 1112
WP_001040092    1050 LAD-ETVVVKDDIE VNNET-GE-IAWDKKKKHFATVRKVLS-YPQVNIVKKTEVQT GGFSK ESIL-AHG- 1112
WP_001040094    1050 LAD-GTVVVKDDIE VNNDT-GE-IWDKKKKHFATVRKVLS-YPQNNIVKKTEIQT GGFSK ESIL-AHS- 1112
WP_001040095    1050 LAD-GTVVVKDDIE VNNDT-GE-IWDKKKKHFATVRKVLS-YPQVNIVKKTEVQT GGFSK ESIL-AHG- 1112
WP_001040096    1050 LAD-GTVVVKDDIE VNNDT-GE-IWDKKKKHFATVRKVLS-YPQNNIVKKTEIQT GGFSK ESIL-AHG- 1112
WP_001040097    1050 LAD-GTVVVKDDIE VNNDT-GE-IWDKKKKHFATVRKVLS-YPQNNIVKKTEIQT GGFSK ESIL-AHG- 1112
WP_001040098    1050 LAD-GTVVVKDDIE VNNDT-GE-IWDKKKKHFATVRKVLS-YPQNNIVKKTEIQT GGFSK ESIL-AHG- 1112
WP_001040099    1050 LAD-GTVVVKDDIE VNNDT-GE-IWDKKKKHFATVRKVLS-YPQNNIVKKTEIQT GGFSK ESIL-AHG- 1112
WP_001040100    1050 LAD-GTVVVKDDIE VNNDT-GE-IWDKKKKHFATVRKVLS-YPQNNIVKKTEIQT GGFSK ESIL-AHG- 1112
WP_001040104    1050 LAD-GTVVVKDDIE VNNDT-GE-IWDKKKKHFATVRKVLS-YPQNNIVKKTEIQT GGFSK ESIL-AHG- 1112
WP_001040105    1050 LAD-GTVVVKDDIE VNNDT-GE-IWDKKKKHFATVRKVLS-YPQNNIVKKTEIQT GGFSK ESIL-AHG- 1112
WP_001040106    1050 LAD-GTVVVKDDIE VNNDT-GE-IWDKKKKHFATVRKVLS-YPQNNIVKKTEIQT GGFSK ESIL-AHG- 1112
WP_001040107    1050 LAD-GTVVVKDDIE VNNDT-GE-IWDKKKKHFATVRKVLS-YPQNNIVKKTEIQT GGFSK ESIL-AHG- 1112
WP_001040108    1050 LAD-GTVVVKDDIE VNNDT-GE-IWDKKKKHFATVRKVLS-YPQNNIVKKTEIQT GGFSK ESIL-AHG- 1112
WP_001040109    1050 LAD-GTVVVKDDIE VNNDT-GE-IWDKKKKHFATVRKVLS-YPQNNIVKKTEIQT GGFSK ESIL-AHG- 1112
WP_001040110    1050 LAD-GTVVVKDDIE VNNDT-GE-IWDKKKKHFATVRKVLS-YPQNNIVKKTEIQT GGFSK ESIL-AHG- 1112
WP_015058523    1050 LAD-GTVVVKDDIE VNNET-GE-IAWDKKKKHFATVRKVLS-YPQNNIVKKTEIQT GGFSK ESIL-AHS- 1112
WP_017643650    1050 LAD-GTVVVKDDIE VNNDT-GE-IWDKKKKHFATVRKVLS-YPQNNIVKKTEIQT GGFSK ESIL-AHG- 1112
WP_017647151    1050 LAD-GTVVVKDDIE VNNDT-GE-IWDKKKKHFATVRKVLS-YPQNNIVKKTEIQT GGFSK ESIL-AHG- 1112
WP_017648376    1050 LAD-GTVVVKDDIE VNNDT-GE-IWDKKKKHFATVRKVLS-YPQNNIVKKTEIQT GGFSK ESIL-AHG- 1112
WP_017649527    1050 LAD-GTVVVKDDIE VNNDT-GE-IWDKKKKHFATVRKVLS-YPQNNIVKKTEIQT GGFSK ESIL-AHG- 1112
WP_017771611    1050 LAD-GTVVVKDDIE VNNDT-GE-IWDKKKKHFATVRKVLS-YPQNNIVKKTEIQT GGFSK ESIL-AHG- 1112
WP_017771984    1050 LAD-GTVVIKDDIE VNNDT-GE-IWDKKKKHFATVRKVLS-YPQNNIVKKTEIQT GGFSK ESIL-AHG- 1112
CFQ25032        1050 LAD-GTVVVKDDIE VNNDT-GE-IWDKKKKHFATVRKVLS-YPQNNIVKKTEIQT GGFSK ESIL-AHG- 1112
CFV16040        1050 LAD-GTVVVKDDIE VNNDT-GE-IWDKKKKHFATVRKVLS-YPQNNIVKKTEIQT GGFSK ESIL-AHG- 1112
KLJ37842        1050 LAD-GTVVVKDDIE VNNDT-GE-IWDKKKKHFATVRKVLS-YPQNNIVKKTEIQT GGFSK ESIL-AHG- 1112
KLJ72361        1064 LAD-GTVVVKDDIE VNNDT-GE-IWDKKKKHFATVRKVLS-YPQNNIVKKTEIQT GGFSK ESIL-AHG- 1126
KLL20707        1050 LAD-GTVVVKDDIE VNNDT-GE-IWDKKKKHFATVRKVLS-YPQNNIVKKTEIQT GGFSK ESIL-AHG- 1112
KLL42645        1050 LAD-GTVVVKDDIE VNNDT-GE-IWDKKKKHFATVRKVLS-YPQNNIVKKTEIQT GGFSK ESIL-AHG- 1112
WP_047207273    1050 LAD-GTVVVKDDIE VNNDT-GE-IWDKKKKHFATVRKVLS-YPQNNIVKKTEIQT GGFSK ESIL-AHG- 1112
WP_047209694    1050 LAD-GTVVVKDDIE VNNDT-GE-IWDKKKKHFATVRKVLS-YPQNNIVKKTEIQT GGFSK ESIL-AHG- 1112
WP_050198062    1050 LAD-GTVVVKDDIE VNNDT-GE-IWDKKKKHFATVRKVLS-YPQNNIVKKTEIQT GGFSK ESIL-AHG- 1112
WP_050201642    1050 LAD-GTVVVKDDIE VNNDT-GE-IWDKKKKHFATVRKVLS-YPQNNIVKKTEIQT GGFSK ESIL-AHG- 1112
WP_050204027    1050 LAD-GTVVVKDDIE VNNDT-GE-IWDKKKKHFATVRKVLS-YPQNNIVKKTEIQT GGFSK ESIL-AHG- 1112
WP_050881965    1050 LAD-GTVVVKDDIE VNNDT-GE-IWDKKKKHFATVRKVLS-YPQNNIVKKTEIQT GGFSK ESIL-AHG- 1112
WP_050886065    1050 LAD-GTVVVKDDIE VNNDT-GE-IWDKKKKHFATVRKVLS-YPQNNIVKKTEIQT GGFSK ESIL-AHG- 1112
```

-continued

| | | | | | | | |
|---|---|---|---|---|---|---|---|
| AHN30376 | 1050 | LAD-ETVVVKDDIE | VNNET-GE- | IAWDKKKHPATVRKVLS | YPQVNIVKKTEVQT | GGFSK | ESIL-AHS- | 1112 |
| EA078426 | 1050 | LAD-GTVVVKDDIE | VNNDT-GE- | IVWDKKKHFATVRKVLS | YPQNNIVKKTEIQT | GGFSK | ESIL-AHG- | 1112 |
| CCW42055 | 1050 | LAD-GTVVVKDDIE | VNNDT-GE- | IVWDKKKHFATVRKVLS | YPQNNIVKKTEIQT | GRFSK | ESIL-AHG- | 1112 |
| WP_003041502 | 1051 | FAD-GTVVERPDIE | T-SED-GE- | IAWNKQTDFKIVRKVLS | YPQVNIVKKTEVQT | HGLDR | PSPK-PKP- | 1122 |
| WP_037593752 | 1043 | -------DIQ | T-NED-GE- | IAWNKEKHIKILRKVLS | YPQVNIVKKTEEQT | GGFSK | ESIL-PKG- | 1094 |
| WP_049516684 | 1042 | -------DIQ | T-NED-GE- | IAWNKEKHIKILRKVLS | YPQVNIVKKTEEQT | GGFSK | ESIL-PKG- | 1093 |
| GAD46167 | 1042 | -------DIQ | T-NED-GE- | IAWNKEKHIKILRKVLS | YPQVNIVKKTEEQT | GGFSK | ESIL-PKG- | 1093 |
| WP_018363470 | 1063 | YSN-GKVIVRPVVE | Y-SKDtGE- | IAWNKRTDFEKVRKVLA | MPQVNIVKKTEVQT | GGFSK | ESIL-SKR- | 1125 |
| WP_003043819 | 1061 | LAN-GEIRKRPLIE | TNGET-GE- | VVWNKEKDFATVRKVLS | YPQVNIVKKTEEQT | GGFSK | ESIL-PKG- | 1123 |
| WP_006269658 | 1042 | -------DIQ | T-NED-GE- | IAWNKEKHIKILRKVLS | YPQVNIVKKTEEQT | GGFSK | ESIL-PKG- | 1093 |
| WP_048800889 | 1052 | FAD-GTVVERPDIE | T-SED-GE- | IVWDKGRDFATVRKVLS | YPQVNIVKKTEIQT | GRFSK | ESIL-PKG- | 1113 |
| WP_012767106 | 1051 | LAN-GEIRKRPLIE | TNEET-GE- | IVWDKGRDFATVRKVLS | MPQVNIVKKTEVQT | GALTN | ESIY-ARG- | 1113 |
| WP_014612333 | 1051 | LAN-GEIRKRPLIE | TNEET-GE- | IVWDKGRDFATVRKVLS | MPQVNIVKKTEVQT | GALTN | ESIY-ARG- | 1113 |
| WP_015017095 | 1051 | LAN-GEIRKRPLIE | TNEET-GE- | IVWDKGRDFATVRKVLS | MPQVNIVKKTEVQT | GALTN | ESIY-ARG- | 1113 |
| WP_015057649 | 1051 | LAN-GEIRKRPLIE | TNEET-GE- | IVWDKGRDFATVRKVLS | MPQVNIVKKTEVQT | GALTN | ESIY-ARG- | 1113 |
| WP_048327215 | 1051 | LAN-GEIRKRPLIE | TNEET-GE- | IVWDKGRDFATVRKVLS | MPQVNIVKKTEVQT | GALTN | ESIY-ARG- | 1113 |
| WP_049519324 | 1051 | LAN-GEIRKRPLIE | TNEET-GE- | IVWDKGRDFATVRKVLS | MPQVNIVKKTEVQT | GALTN | ESIY-ARG- | 1113 |
| WP_012515931 | 1044 | L------H | VNSD--GE- | EIWNANKHLPIIKNVLS | IPQVNIVKKTEVQT | GGFYK | ESIL-SKG- | 1094 |
| WP_021320964 | 1044 | L------H | VNSD--GE- | EIWNANKHLPIIKNVLS | IPQVNIVKKTEVQT | GGFYK | ESIL-SKG- | 1094 |
| WP_037581760 | 1062 | YAD-GRVFERPDIE | T-NAD-GE- | VVWNKQRDFNIVRKVLS | YPQVNIVKKTEVQT | GALTN | ESIY-ARG- | 1123 |
| WP_004324481 | 1057 | YAD-GTVFERPIIE | T-NAD-GE- | IAWNKQIDFEKVRKVLS | YPQVNIVKKVETQT | GGFSK | ESIL-PKG- | 1118 |
| WP_009854540 | 1059 | YSN-GKVVVRPVIE | C-SKDtGE- | IAWNKQTDFEKVRKVLS | YPQVNIVKKVETQT | GGFSK | ESIL-PKG- | 1119 |
| WP_012962174 | 1062 | YAD-GRVFERPDIE | T-NAD-GE- | VVWNKQKDFDIVRKVLS | YPQVNIVKKVEAQT | GGFSK | ESIL-PKG- | 1120 |
| WP_039695303 | 1052 | LAD-DTIFTRPQIE | VNTET-GE- | IVWDKVKDMQTIRKVMS | YPQVNIVMKTEVQT | GGFSK | ESIW-PKG- | 1123 |
| WP_014334983 | 1052 | LAD-DTIFTRPQIE | VNTET-GE- | IVWDKVKDMQTIRKVMS | YPQVNIVKKTEVQT | GGFSK | ESIL-SKG- | 1114 |
| WP_003099269 | 1052 | LAD-DTIFTRPQIE | VNTET-GE- | IVWDKVKDMQTIRKVMS | YPQVNIVMKTEVQT | GGFSK | ESIW-PKG- | 1114 |
| AHY17476 | 1052 | LAD-DTIFTRPQIE | VNTET-GE- | IVWDKVKDMQTIRKVMS | YPQVNIVMKTEVQT | GGFSK | ESIW-PKG- | 1114 |
| AHY15608 | 1052 | LAD-DTIFTRPQIE | VNTET-GE- | IVWDKVKDMQTIRKVMS | YPQVNIVMKTEVQT | ----- | --------- | 1114 |
| ESR09100 | 1052 | LAD-DTIFTRPQIE | VNTET-GE- | IVWDKVKDMQTIRKVMS | YPQVNIVMKTEVQT | ----- | --------- | 1114 |
| AGM98575 | 1052 | LAD-DTIFTRPQIE | VNTET-GE- | IVWDKVKDMQTIRKVMS | YPQVNIVKKVEEQT | GGFSK | ESIW-PKG- | 1114 |
| ALF27331 | 1056 | -K------K | -DQEtGE- | IVWDKKEIENIVKKVIY | SSPVNIVKKREEQS | GALFK | QSNM-AVGy | 1108 |
| WP_018372492 | 1057 | YAD-GTIVKRENIE | Y-SKDtGE- | IVWDKKETENIVKKVIY | LPQVNIVKKTEEQT | GGLFD | NNIV-SKKk | 1124 |
| WP_045618028 | 1056 | YAD-GTIVKRENIE | Y-SKDtGE- | IAWNKEKDFATIKKVLS | LPQVNIVKKREVQT | GGFSK | ESIL-PKG- | 1118 |
| WP_045635197 | 1042 | -----DVR | T-DKN-GE- | IIWKKDEHISNIKKVLS | YPQVNIVKKVEEQT | GGFSK | ESIL-PKG- | 1093 |
| WP_002263549 | 1042 | -----DVR | T-DKN-GE- | IIWKKDEHISNIKKVLS | YPQVNIVKKVEEQT | GGFSK | ESIL-PKG- | 1093 |
| WP_002263887 | 1042 | -----DVR | T-DKN-GE- | IIWKKDEHISNIKKVLS | YPQVNIVKKVEEQT | GGFSK | ESIL-PKG- | 1093 |
| WP_002264920 | 1042 | -----DVR | T-DKN-GE- | IIWKKDEYISNIKKVLS | YPQVNIVKKVEEQT | GGFSK | ESIL-PKG- | 1093 |
| WP_002269043 | 1042 | -----DVR | T-DRN-GE- | IIWKKDEHISNIKKVLS | YPQVNIVKKVEEQT | GGFSK | ESIL-PKG- | 1093 |
| WP_002269448 | 1047 | LAD-DQIVERPMIE | VNDET-GE- | IAWDKTKHITTVKKVLS | YPQVNIVKKVEEQT | GGLFD | -----PKS- | 1111 |
| WP_002271977 | 1042 | -----DVR | T-DKN-GE- | IIWKKDKTKHITTVKKVLS | YPQVNIVKKVEEQT | GGLFD | -----PKS- | 1093 |
| WP_002272766 | 1042 | -----DVR | T-DKN-GE- | IIWKKDEHISNIKKVLS | YPQVNIVKKVEEQT | GGFSK | ESIL-PKG- | 1093 |
| WP_002273241 | 1042 | -----DVR | T-DKN-GE- | IIWKKDEHISNIKKVLS | YPQVNIVKKVEEQT | GGFSK | ESIL-PKG- | 1093 |
| WP_002275430 | 1042 | -----DVR | T-DKN-GE- | IIWKKDEHISNIKKVLS | YPQVNIVKKVEEQT | GGFSK | ESIL-PKG- | 1093 |
| WP_002276448 | 1042 | -----DVR | T-DKN-GE- | IIWKKDEHISNIKKVLS | YPQVNIVKKVEEQT | GGFSK | ESIL-PKG- | 1093 |
| WP_002277050 | 1042 | -----DVR | T-DKN-GE- | IIWKKDEHISNIKKVLS | YPQVNIVKKVEEQT | GGFSK | ESIL-PKG- | 1093 |
| WP_002277364 | 1047 | LAD-DQIVERPMIE | VNDET-GE- | IAWDKTKHITTVKKVLS | YPQVNIVKKVEEQT | GGLFD | -----PKS- | 1111 |
| WP_002279025 | 1042 | -----DVR | T-DKN-GE- | IIWKKDEHISNIKKVLS | YPQVNIVKKVEEQT | GGFSK | ESIL-PKG- | 1093 |
| WP_002279859 | 1042 | -----DVR | T-DKN-GE- | IIWKKDEHISNIKKVLS | YPQVNIVKKVEEQT | GGFSK | ESIL-PKG- | 1093 |
| WP_002280230 | 1042 | -----DVR | T-DKN-GE- | IIWKKDEHISNIKKVLS | YPQVNIVKKVEEQT | GGFSK | ESIL-PKG- | 1093 |
| WP_002281696 | 1042 | -----DVR | I-DKN-GE- | IIWKKDEHISNIKKVLS | YPQVNIVKKVEEQT | GGLFD | -----PKS- | 1093 |
| WP_002282247 | 1042 | -----DVR | T-DKN-GE- | IIWKKDEHISNIKKVLS | YPQVNIVKKVEEQT | GGLFD | -----PKS- | 1093 |
| WP_002282906 | 1042 | -----DVR | T-DKN-GE- | IIWKKDEHISNIKKVLS | YPQVNIVKKVEEQT | GGFSK | ESIL-PKG- | 1093 |
| WP_002283846 | 1042 | -----DVR | T-DKN-GE- | IIWKKDEHISNIKKVLS | YPQVNIVKKVEEQT | GGFSK | ESIL-PKG- | 1093 |

| | | | | | |
|---|---|---|---|---|---|
| WP_002287255 | 1042 | -------DVR | T-DKN-GE- | IIWKKDEHISNIKKVLS-YPQVNIVKKVEEQT GGFSK ESIL-PKG- | 1093 |
| WP_002288990 | 1042 | -------DVR | T-DKN-GE- | IIWKKDEHISNIKKVLS-YPQVNIVKKVEEQT GGFSK ESIL-PKG- | 1093 |
| WP_002289641 | 1042 | -------DVR | T-DKN-GE- | IIWKKDEHISNIKKVLS-YPQVNIVKKVEEQT GGFSK ESIL-PKG- | 1093 |
| WP_002290427 | 1042 | -------DVR | T-DKN-GE- | IIWKKDEHISNIKKVLS-YPQVNIVKKVEEQT GGFSK ESIL-PKG- | 1093 |
| WP_002295753 | 1042 | -------DVR | T-DKN-GE- | IIWKKDEYISNIKKVLS-YPQVNIVKKVEEQT GGFSK ESIL-PKG- | 1093 |
| WP_002296423 | 1042 | -------DVR | T-DKN-GE- | IIWKKDEHISNIKKVLS-YPQVNIVKKVEEQT GGFFK ESIL-PKG- | 1093 |
| WP_002304487 | 1056 | -------DVR | T-DKN-GE- | IIWKKDEHISNIKKVLS-YPQVNIVKKVEEQT GGFSK ESIL-PKG- | 1107 |
| WP_003105844 | 1056 | -------DVR | T-DKN-GE- | IIWKKDEHISNIKKVLS-YPQVNIVKKVEEQT GGFSK ESIL-PKG- | 1107 |
| WP_003107203 | 1042 | -------DVR | T-DKN-GE- | IIWKKDEHISNIKKVLS-YPQVNIVKKVEEQT GGFSK ESIL-PKG- | 1093 |
| WP_003110390 | 1042 | -------DVR | T-DKN-GE- | IIWKKDEYISNIKKVLS-YPQVNIVKKVEEQT GGFSK ESIL-PKG- | 1093 |
| WP_003352408 | 1042 | -------DVR | T-DKN-GE- | IIWKKDEHISNIKKVLS-YPQVNIVKKVEEQT GGFSK ESIL-PKG- | 1093 |
| WP_012997688 | 1042 | -------DVR | T-DKN-GE- | IIWKKDEHISNIKKVLS-YPQVNIVKKVEEQT GGFSK ESIL-PKG- | 1093 |
| WP_014677909 | 1042 | -------DVR | T-DKN-GE- | IIWKKDEHISNIKKVLS-YPQVNIVKKVEEQT GGFFK ESIL-PKG- | 1093 |
| WP_019312892 | 1042 | -------DVR | T-DKN-GE- | IIWKKDEYISNIKKVLS-YPQVNIVKKVEEQT GGFSK ESIL-PKG- | 1093 |
| WP_019313659 | 1042 | -------DVR | T-DKN-GE- | IIWKKDEYISNIKKVLS-YPQVNIVKKVEEQT GGFSK ESIL-PKG- | 1093 |
| WP_019314093 | 1042 | -------DVR | T-DKN-GE- | IIWKKDEHISNIKKVLS-YPQVNIVKKVEEQT GGFSK ESIL-PKG- | 1093 |
| WP_019315370 | 1042 | -------DVR | T-DKN-GE- | IIWKKDEHISNIKKVLS-YPQVNIVKKVEEQT GGFSK ESIL-PKG- | 1093 |
| WP_019803776 | 1042 | -------DVR | T-DKN-GE- | IIWKKDEHISNIKKVLS-YPQVNIVKKVEEQT GGFFK ESIL-PKG- | 1093 |
| WP_019805234 | 1042 | -------DVR | T-DKN-GE- | IIWKKDEHISNIKKVLS-YPQVNIVKKVEEQT GGFFK ESIL-PKG- | 1093 |
| WP_024783594 | 1042 | -------DVR | T-DKN-GE- | IIWKKDEHISNIKKVLS-YPQVNIVKKVEEQT GGFSK ESIL-PKG- | 1093 |
| WP_024784288 | 1047 | LAD-DQIVERPMIE | VNDET-GE- | IAWDKTKHITTVKKVLS-YPQVNIVKKVEEQT GGLFD ----PKS- | 1111 |
| WP_024784666 | 1042 | -------DVR | T-DKN-GE- | IIWKKDEHISNIKKVLS-YPQVNIVKKVEEQT GGFSK ESIL-PKG- | 1093 |
| WP_024784894 | 1042 | -------DVR | T-DKN-GE- | IIWKKDEHISNIKKVLS-YPQVNIVKKVEEQT GGFSK ESIL-PKG- | 1093 |
| WP_024786433 | 1047 | LAD-DQIVERPMIE | VNDET-GE- | IAWDKTKHITTVKKVLS-YPQVNIVKKVEEQT GGLFD ----PKS- | 1111 |
| WP_049473442 | 1053 | LAN-GNIIKRSPIE | VNKET-GE- | IVWDKVKDIKTIRKVLS-IPQINVVKKTEIQT GGFSN ETIL-SKR- | 1115 |
| WP_049474547 | 1042 | -------DVR | T-DKN-GE- | IIWKKDEHISNIKKVLS-YPQVNIVKKVEEQT GGFSK ESIL-PKG- | 1093 |
| EMC03581 | 1035 | -------DVR | T-DKN-GE- | IIWKKDEHISNIKKVLS-YPQVNIVKKVEEQT GGFSK ESIL-PKG- | 1086 |
| WP_000428612 | 1059 | YAD-GTIVKRENIE | Y-SKDtGE- | IAWNKEKDFATIKKVLS-LPQVNIVKKVEEQT GGLFD NNIV-SKKk | 1121 |
| WP_000428613 | 1052 | YAD-GTIIQRGNVE | Y-SKDtGE- | IAWNNEKDFATIKKVLS-YPQVNIVKKVEEQT GGLFD NNIV-SKEk | 1114 |
| WP_049523028 | 1021 | YAD-GTIVITRPQIE | TNTET-GE- | IVWDKVKDIKTKDFGTVRKVLS-IPQINVVKKTEVQT GGFSK ETIL-SKG- | 1083 |
| WP_049523028 | 1021 | YAD-GTIVITRPQIE | TNTET-GE- | IVWDKVKDIKTKDFGTVRKVLS-IPQINVVKKTEVQT GGFSK ETIL-SKG- | 1083 |
| WP_054279288 | 1053 | LAN-GNIIKRSPIE | VNEET-GE- | IVWDKTKDFGTVRKVLS-APQVNIVKKTEIQT GGFSN ETIL-SKG- | 1115 |
| WP_049531101 | 1057 | YAD-GTIVKRENIE | Y-SKDtGE- | IAWNKEIDFATIRKILS-LSQVNIVKKTEEQT GGLFD NNIV-SKKk | 1124 |
| WP_049538452 | 1057 | YAD-GTIVKRENIE | Y-SKDtGE- | IAWNNEKDFATIKKILS-LPQVNIVKKTEEQT GGLFD NNIV-SKEk | 1124 |
| WP_049549711 | 1059 | YAD-GTIVKRENIE | Y-SKDtGE- | IAWNNEKDFATIKKVLS-YPQVNIVKKTEEQT GGLFD NNIV-SKEK | 1126 |
| WP_007896501 | 1058 | LAD-GTLMKRPVIE | TNTET-GE- | VVWDKVKDFKTIRKVLS-YPQVNIVKKTEIQS GAFSK ESVL-SKG- | 1120 |
| EFR44625 | 1010 | LAD-GTLMKRPVIE | TNTET-GE- | VVWDKTKHFANVKRVLS-YPQVNIVKKTEIQS ESVL ESVL-SKG- | 1072 |
| WP_002897477 | 1056 | LAD-GRVVEKPVIE | ANEET-GE- | IAWDKTKHFANVKRVLS-YPQVNIVKKVEEQT GGLFD NNIV-SKKk | 1118 |
| WP_002906454 | 1056 | YAD-GTIKKRENIE | Y-SNDtGE- | IAWNNEKDFVTIKKVLS-LPQVNIVKKREVQT GGLFD NNIV-SKKk | 1123 |
| WP_009729476 | 1057 | YAD-GTIVKRENIE | Y-SKDtGE- | IAWNNEKDFATIKKVLS-YPQVNIVKKREVQT GGFSK ESIL-PKG- | 1119 |
| CQR24647 | 1061 | YAD-GTIVTRPQIE | TNTET-GE- | IVWDKKSDFRTVRKVLS-YPQVNIVKKVEMQT GGFSK ESIL-QHG- | 1123 |
| WP_000066813 | 1057 | YAD-GTIVKRENIE | Y-SKDtGE- | IVWDKKSDFRTVRKVLS-YPQVNIVKKREVQT GGFSK ESIL-PKG- | 1119 |
| WP_009754323 | 1049 | YSktGEVRIRPVIE | VNKET-GE- | IVWDKKSDFRTVRKVLS-YPQVNNVKKVEMQT GGFSK ESIL-QHG- | 1112 |
| WP_044676715 | 1051 | YSktGEVRIRPVIE | VNKET-GE- | IVWDKKSDFKTVRKVLS-YPQVNVVKKVEMQT GGFSK ESIL-QHG- | 1114 |
| WP_044680361 | 1051 | YSktGEVRIRPVIE | VNKET-GE- | IVWDKKSDFKTVRKVLS-YPQVNVVKKVEMQT GGFSK ESIL-QHG- | 1112 |
| WP_044681799 | 1049 | YSktGEVRIRPVIE | VNKET-GE- | IVWDKNQTDFKIVRKVLS-YPQVNIVKKTEVQT HGLDR PSPK-PKP- | 1112 |
| WP_049533112 | 1051 | FAD-GTVVERPDIE | T-SED-GE- | IAWNKPEVDIAKLKRILN-FKQCNIVRKVEEQS GALFK ETIY-PVEe | 1122 |
| WP_029090905 | 1008 | -KQ----- | ----Q | -----GK LIWNP-DLINEIKKCFY-YKDCYCTTTKLDQKS GQLFN -TVL-SNDa | 1061 |
| AIT42264 | 1039 | -D------ | -- | ----LA --NPD-GE- IAWEKDKDLNTIRKVLS-SKQINIIKKABEGK GRLFK ETIN-SRPs | 1084 |
| WP_034440723 | 1052 | LAN-GEIRKRPLIE | TNGET-GE- | IVWDKGRDFATVRKVLS-MPQVNIVKKTEVQT GGFSK ESIL-PKR- | 1114 |
| AKQ21048 | 1052 | LAN-GEIRKRPLIE | TNGET-GE- | IVWDKGRDFATVRKVLS-MPQVNIVKKTEVQT GGFSK ESIL-PKR- | 1114 |

-continued

```
WP_004636532   1043 ------------- VNEET-GE- ILWDTERHLSTIKRVLS-WKQMNIVKKVEKQK GQLWK ETIY-PKG- 1092
WP_002364836   1048 -E----------P RFTKD-GE- ILWSN-SYLKTIKKELN-YHQMNIVKKVEVQK GGFSK ESIK-PKG- 1098
WP_016631044    999 -E----------P RFTKD-GE- ILWSN-SYLKTIKKELN-YHQMNIVKKVEVQK GGFSK ESIK-PKG- 1049
EMS75795        783 -E----------Y SYDEN-GE- IFWDKARHIPQIKKVIS-SHQVNIVKKVEVQT GGFSK ETVN-PKG-  834
WP_002373311   1048 -E----------P RFTKD-SE- ILWSN-SYLKTIKKELN-YHQMNIVKKVEVQK GGFSK ESIK-PKG- 1098
WP_002378009   1048 -E----------P RFTKD-GE- ILWSN-SYLKTIKKELN-YHQMNIVKKVEVQK GGFSK ESIK-PKG- 1098
WP_002407324   1048 -E----------P RFTKD-GE- ILWSN-SYLKTIKKELN-YHQMNIVKKVEVQK GGFSK ESIK-PKG- 1098
WP_002413717   1048 -E----------P RFTKD-GE- ILWSN-SYLKTIKKELN-YHQMNIVKKVEVQK GGFSK ESIK-PKG- 1098
WP_010775580   1050 -E----------P RFTKD-GE- ILWSN-SYLKTIKKELN-YHQMNIVKKVEVQK GGFSK ESIK-PKG- 1100
WP_010818269   1048 -E----------P RFTKD-GE- ILWSN-SYLKTIKKELN-YHQMNIVKKVEVQK GGFSK ESIK-PKG- 1098
WP_010824395   1048 -E----------P RFTKD-GE- ILWSN-SYLKTIKKELN-YHQMNIVKKVEVQK GGFSK ESIK-PKG- 1098
WP_016622645   1048 -E----------P RFTKD-GE- ILWSN-SYLKTIKKELN-YHQMNIVKKVEVQK GGFSK ESIK-PKG- 1098
WP_033624816   1048 -E----------P RFTKD-GE- ILWSN-SYLKTIKKELN-YHQMNIVKKVEVQK GGFSK ESIK-PKG- 1098
WP_033625576   1048 -E----------P RFTKD-GE- ILWSN-SYLKTIKKELN-YHQMNIVKKVEVQK GGFSK ESIK-PKG- 1098
WP_033789179   1048 -E----------P RFTKD-GE- ILWSN-SYLKTIKKELN-YHQMNIVKKVEVQK GGFSK ESIK-PKG- 1098
WP_002310644   1049 -T----------P VCDEN-GE- IFWDKSKSIAQVKKVIN-HHHMNIVKKTEIQK GGFSK ETVE-PKK- 1100
WP_002112694   1050 -T----------P VCDEN-GE- IFWDKSKSIAQVKKVIN-HHHMNIVKKTEIQK GGFSK ETVE-PKK- 1101
WP_002314015   1050 -T----------P VCDEN-GE- IFWDKSKSIAQVKKVIN-HHHMNIVKKTEIQK GGFSK ETVE-PKK- 1101
WP_002345439   1050 -T----------P VCDEN-GE- IFWDKSKSIAQVKKVIN-HHHMNIVKKTEIQK GGFSK ETVE-PKK- 1101
WP_002320716   1049 -T----------P VCDEN-GE- IFWDKSKSIAQVKKVIN-HHHMNIVKKTEIQK GGFSE ETVE-PKK- 1100
WP_002330729   1050 -T----------P VCDEN-GE- IFWDKSKSIAQVKKVIN-HHHMNIVKKTEIQK GGFSK ETVE-PKK- 1101
WP_002335161   1050 -T----------P VCDEN-GE- IFWDKSKSIAQVKKVIN-HHHMNIVKKTEIQK GGFSK ETVE-PKK- 1101
WP_034867970   1040 -T----------P FCDEN-GE- IYWEKSHHLPRIKKVLS-SHQVNVVKKVEQQK GGFSK ETVN-SKE- 1091
WP_047937432   1050 -T----------P FCDEN-GE- IYWEKSHHLPRIKKVLS-SHQVNVVKKVEQQK GGFSK ETVN-SKE- 1101
WP_010720994   1040 -T----------P FCDEN-GE- IYWEKSHHLPRIKKVLS-SHQVNVVKKVEQQK GGFYK ETVN-SKE- 1091
WP_010737004   1040 -E----------P FCDEN-GE- IYWEKSHHLPRIKKVLS-SHQVNVVKKVEQQK GGFYK ETVN-SKE- 1091
WP_034700478   1038 -D----------I INDD-GE- ILNNKQETIAQVIKTLG-MHQVNIVKKTEIQK GGFYK ESIQ-PKG- 1089
WP_007209003   1034 -E----------I ICDEQ-GE- VIWNKKRDLsTIKKTIG-AHQVNIVKKVEKQK GGFYK ETIN-SKA- 1085
WP_023519017   1046 -A----------V IIDEN-GE- ILWDK-KNIATVKKVMS-YPQMNIVKKPEIQT GSFSK ETIK-PKG- 1096
WP_010770040   1043 -K----------V IIDEN-GE- ILWNQ-KKIVTVKKVMN-YRQMNIVKKVEIQK GGFSK ESIL-PKG- 1093
WP_048604708   1043 -E----------V FCDEN-GE- IFWDKRKHIQQIKKVIS-SHQVNIVKKVEVQT GGFYK ETVN-TKE- 1094
WP_010750235   1091 LAN-GEIRKRPLIE TNGET-GE- IVWDKGRDFATVRKVLS-MPQVNIVKKTEVQT GSFSK ESIL-PKR- 1153
AII16583       1053 -D----------- ---T-GE- EWISRIKKCFY-YKDCFVTKKLEENN GSFFN -TVR-PNDe 1099
WP_029073316   1053 -D----------- ---T-GE- IVWDP-NYIDRIKKCFY-YKDCFVTKKLBENN GTFFN -TVL-PNDt 1099
WP_031589969   1035 -N----------- ---------WDKARDLPTIKRYLY-RAQVNKVRKAERQT GGFSD EMLV-PKS- 1078
KDA45870       1044 -E----------E LVDEN-TBaVIWNKESGLAYLNKIYQ-FKKILVTREVHENS GALFN QTLYaAKDq 1097
WP_039099354   1063 -N----------GTTQ --DRNtGE- IIWNVG-FRDKILKIFN-YHQCNVTRKTEIKT GQFYD QTIYsPKNp 1118
AKP02966       1045 -D----------R IIDEN-GE- ILWDK-KYLDTVKKVMS-YRQMNIVKKTEIQK GEFSK ATIK-PKG- 1095
WP_010991369   1048 -D----------R IIDEN-GE- ILWDK-KYLDTVKKVMS-YRQMNIVKKTEIQK GEFSK ATIK-PKG- 1098
WP_033838504    814 -D----------R IIDEN-GE- ILWDK-KYLETIKKVLD-YRQMNIVKKTEIQK GEFSK ATIK-PKG-  864
EHN60060       1045 -D----------R IIDEN-GE- ILWDK-KYLETIKKVLD-YRQMNIVKKTEIQK GEFSK ATIK-PKG- 1095
EFR89594       1045 -N----------Q IIDEN-GE- ILWDN-RYLDTIKKVLS-YRQMNIVKKTEIQK GEFSN ATVN-PKG- 1095
WP_038409211    664 -N----------Q IIDEN-GE- ILWDN-RYLDTIKKVLS-YRQMNIVKKTEIQK GEFSN ATVN-PKG-  714
EFR95520       1045 -E----------R IIDEN-GE- ILWDK-KYLETIKKVLD-YRQINIVKKTEIQK GEFSK ATIK-PKG- 1095
WP_003723650   1045 -E----------R IIDEN-GE- ILWDK-KYLETIKKVLD-YRQINIVKKTEIQK GEFSK ATIK-PKG- 1095
WP_003727705   1045 -E----------R IIDEN-GE- ILWDK-KYLETIKKVLG-YRQMNIVKKTEIQK GEFSK VTPN-PKG- 1095
WP_003730785   1045 -E----------R IIDEN-GE- ILWDK-KYLETIKKVLD-YRQMNIVKKTEIQK GEFSK ATIK-PKG- 1095
WP_003733029   1045 -E----------R IIDEN-GE- ILWDK-KYLETIKKVLD-YRQMNIVKKTEIQK GEFSK ATIK-PKG- 1095
WP_003739838   1045 -E----------R IIDEN-GE- ILWDK-KYLETIKKVLD-YRQMNIVKKTEIQK GEFSN VTPN-PKG- 1095
WP_014601172   1045 -E----------R IIDEN-GE- ILWDK-KYLETIKKVLN-YRQMNIVKKTEIQK GEFSN ATIK-PKG- 1095
WP_023548323   1045 -E----------R IIDEN-GE- ILWDK-KYLETIKKVLD-YRQMNIVKKTEIQK GEFSK QNPK-PRG- 1095
WP_031665337   1045 -E----------R IIDEN-GE- ILWDK-KYLETIKKVLD-YRQMNIVKKTEIQK GEFSK ATIK-PKG- 1095
WP_031669209   1045 -D----------R IIDEN-GE- ILWDK-RYLETVKKVLG-YRQMNIVKKTEIQK GEFSN VTPN-PKG- 1095
```

```
WP_033920898  1045  -E--------R IIDEN-GE- ILWDK-KYLETIKKVLN-YRQMNIVKKTEIQK GEFSN QNPK-PRG-                                                                                                 1095
AKI42028      1048  -E--------R IIDEN-GE- ILWDK-KYLETIKKVLD-YRQMNIVKKTEIQK GEFSK ATIK-PKG-                                                                                                 1098
AKI50529      1048  -E--------R IIDEN-GE- ILWDK-KYLETIKKVLN-YRQMNIVKKTEIQK GEFSN QNPK-PRG-                                                                                                 1098
EFR83390       493  -E--------R IIDEN-GE- ILWDK-KYLETIKKVLD-YRQMNIVKKTEIQK GEFSK ATIK-PKG-                                                                                                  543
WP_046323366  1045  -D--------R IIDEN-GE- ILWDK-KYLDTIKKVLN-YRQMNIVKKTEIQK GEFSN ATAN-PKG-                                                                                                 1095
AKE81011      1068  LAN-GEIRKRPLIE TNGET-GE- IVWDKGRDFATVRKVLS-MPQVNIVKKTEVQT GGFSK ESIL-PKR-                                                                                              1130
CUO82355      1043  -D-------- ---------GK-LIWNP-DLINEIKKCFY-YKDCYCTTKLDQKS QMFN -TVL-PNDa                                                                                                  1088
WP_033162887  1085  -D-------- ---------T-GE-VMWDP-AKIGKIKSCFY-YKDVVTKKLEQNS GTLFN -TVL-PNDa                                                                                                1089
AGZ01981      1052  LAN-GEIRKRPLIE TNGET-GE- IVWDKGRDFATVRKVLS-MPQVNIVKKTEVQT GGFSK ESIL-PKR-                                                                                              1147
AKA60242      1052  LAN-GEIRKRPLIE TNGET-GE- IVWDKGRDFATVRKVLS-MPQVNIVKKTEVQT GGFSK ESIL-PKR-                                                                                              1114
AKS40380      1056  LAN-GEIRKRPLIE TNGET-GE- IVWDKGRDFATVRKVLS-MPQVNIVKKTEVQT GGFSK ESIL-PKR-                                                                                              1114
4UN5_B        1115  -NSD KLIA----RKKDW-DPKKYGGFDSPTVAYSV-LVVAK--VE--KGKSKKLKSVKELLGITIME RSSFEK                                                                                              1118
WP_010922251  1121  -DSD KLIPRTkKV-YW-DTKKYGGFDSPTVAYSV-FVVAD--VE--KGKAKKLKTVKELVGISIME RSFFEE                                                                                              1176
WP_039695303  1119  -NSD KLIPRTkKA-YW-DTKKYGGFDSPVIAYSI-LLIAD--IE--KGKAKKLKTVKTLVGITIME KAAFEE                                                                                              1185
WP_045635197   853  -EKN -LYKYYReTGNYL----TKYSKKDNGPVIKI---- ----KYYGNKLNAHLDITDDYPNS -VKLSL                                                                                                 1183
5AXW_A         799  -NSD KLIA----RKKDW-DPKKYGGFDSPTVAYSV-LVVAK--VE--KGKSKKLKSVKELVGITIME RSSFEK                                                                                              912
WP_009880683  1115  -NSD KLIA----RKKDW-DPKKYGGFDSPTVAYSV-LVVAK--VE--KGKSKKLKSVKELVGITIME RSSFEK                                                                                              860
WP_010922251  1115  -NSD KLIA----RKKDW-DPKKYGGFDSPTVAYSV-LVVAK--VE--KGKSKKLKSVKELLGITIME RSSFEK                                                                                              1176
WP_011054416  1115  -NSD KLIA----RKKDW-DPKKYGGFDSPTVAYSV-LVVAK--VE--KGKSKKLKSVKELLGITIME RSSFEK                                                                                              1176
WP_011284745  1115  -NSD KLIA----RKKDW-DPKKYGGFDSPTVAYSV-LVVAK--VE--KGKSKKLKSVKELLGITIME RSSFEK                                                                                              1176
WP_011285506  1115  -NSD KLIA----RKKDW-DPKKYGGFDSPTVAYSV-LVVAK--VE--KGKSKKLKSVKELLGITIME RSSFEK                                                                                              1176
WP_011527619  1115  -NSD KLIA----RKKDW-DPKKYGGFDSPTVAYSV-LVVAK--VE--KGKSKKLKSVKELLGITIME RSSFEK                                                                                              1176
WP_012560673  1115  -NSD KLIA----RKKDW-DPKKYGGFDSPTVAYSV-LVVAK--VE--KGKSKKLKSVKELLGITIME RSSFEK                                                                                              1176
WP_014407541  1114  -NSD KLIA----RKKDW-DPKKYGGFDSPTVAYSV-LVVAK--VE--KGKSKKLKSVKELLGITIME RSSFEK                                                                                              1175
WP_020905136  1115  -NSD KLIA----RKKDW-DPKKYGGFDSPTVAYSV-LVVAK--VE--KGKSKKLKSVKELLGITIME RSSFEK                                                                                              1176
WP_023080005  1115  -NSD KLIA----RKKDW-DPKKYGGFDSPTVAYSV-LVVAK--VE--KGKSKKLKSVKELLGITIME RSSFEK                                                                                              1175
WP_023610282  1114  -NSD KLIA----RKKDW-DPKKYGGFDSPTVAYSV-LVVAK--VE--KGKSKKLKSVKELLGLTIME RSSFEK                                                                                              1175
WP_030125963  1115  -NSD KLIA----RKKDW-DPKKYGGFDSPTVAYSV-LVVAK--VE--KGKSKKLKSVKELLGITIME RSSFEK                                                                                              1175
WP_030126706  1115  -NSD KLIA----RKKDW-DPKKYGGFDSPTVAYSV-LVVAK--VE--KGKSKKLKSVKELLGITIME RSSFEK                                                                                              1176
WP_031488318  1115  -NSD KLIA----RKKDW-DPKKYGGFDSPTVAYSV-LVVAK--VE--KGKSKKLKSVKELLGITIME RSSFEK                                                                                              1176
WP_032460140  1115  -NSD KLIA----RKKDW-DPKKYGGFDSPTVAYSV-LVVAK--VE--KGKSKKLKSVKELLGITIME RSSFEK                                                                                              1176
WP_032461047  1115  -NSD KLIA----RKKDW-DPKKYGGFDSPTVAYSV-LVVAK--VE--KGKSKKLKSVKELVGITIME RSSFEK                                                                                              1176
WP_032462016  1115  -NSD KLIA----RKKDW-DPKKYGGFDSPTVAYSV-LVVAK--VE--KGKSKKLKSVKELLGITIME RSSFEK                                                                                              1176
WP_032462936  1115  -NSD KLIA----RKKDW-DPKKYGGFDSPTVAYSV-LVVAK--VE--KGKSKKLKSVKELLGITIME RSSFEK                                                                                              1176
WP_032464890   940  -NSD KLIA----RKKDW-DPKKYGGFDSPTVAYSV-LVVAK--VE--KGKSKKLKSVKELLGITIME RSSFEK                                                                                              1001
WP_033888930  1115  -NSD KLIA----RKKDW-DPKKYGGFDSPTVAYSV-LVVAK--VE--KGKSKKLKSVKELLGITIME RSSFEK                                                                                              1176
WP_038431314  1114  -NSD KLIA----RKKDW-DPKKYGGFDSPTVAYSV-LVVAK--VE--KGKSKKLKSVKELLGITIME RSSFEK                                                                                              1175
WP_038432938  1115  -NSD KLIA----RKKDW-DPKKYGGFDSPTVAYSV-LVVAK--VE--KGKSKKLKSVKELLGITIME RSSFEK                                                                                              1176
WP_038434062  1026  -NSD KLIA----RKKDW-DPKKYGGFDSPTVAYSV-LVVAK--VE--KGKSKKLKSVKELLGITIME RSSFEK                                                                                              1087
BAQ51233       290  -NSD KLIA----RKKDW-DPKKYGGFDSPTVAYSV-LVVAK--VE--KGKSKKLKSVKELLGITIME RSSFEK                                                                                              351
KGE60856       290  -NSD KLIA----RKKDW-DPKKYGGFDSPTVAYSV-LVVAK--VE--KGKSKKLKSVKELLGITIME RSSFEK                                                                                              351
KGE66162        53  -NSD KLIA----RKKDW-DPKKYGGFDSPTVAYSV-LVVAK--VE--KGKSKKLKSVKELLGITIME RSSFEK                                                                                              114
WP_002989955  1115  -NSD KLIPRKT-KNSYW-NPKKYGGFDSPTVAYSV-LVFAD--VE--KGKSKKLRKVQDMVGITIME KKRFEK                                                                                              1176
WP_003030002  1094  -ESD KLIPRKT-KNSYW-NPKKYGGFDSPTVAYSV-LVFAD--VE--KGKSKKLKSVKELVGISIME RSFFEK                                                                                              1158
WP_003065552  1122  -DSD KLIPRKTkKA-YW-DTKKYGGFDSPTVAYSV-FVVAD--VE--KGKAKKLKTVKELVGISIME RSFFEE                                                                                              1186
WP_001040076  1113  -NSD KLIPRKT-KDIYL-DPKKYGGFDSPIVAYSV-LVVAD--IK--KGKAQKLKTVTELLGITIME RSKFEK                                                                                              1185
WP_001040078  1113  -NSD KLIPRKT-KDIYL-DPKKYGGFDSPIVAYSV-LVVAD--IK--KGKAQKLKTVTELLGITIME RSKFEK                                                                                              1177
WP_001040080  1113  -NSD KLIPRKT-KDIYL-DPKKYGGFDSPIVAYSV-LVVAD--IK--KGKAQKLKTVTELLGITIME RSRFEK                                                                                              1177
WP_001040081  1113  -NSD KLIPRKT-KDIYL-DPKKYGGFDSPIVAYSV-LVVAD--IK--KGKAQKLKTVTELLGITIME RSRFEK                                                                                              1177
WP_001040083  1113  -NSD KLIPRKT-KDIYL-DPKKYGGFDSPIVAYSV-LVVAD--IK--KGKAQKLKTVTELLGITIME RSRFEK                                                                                              1177
WP_001040085  1113  -NSD KLIPRKT-KDIYL-DPKKYGGFDSPIVAYSV-LVVAD--IK--KGKAQKLKTVTELLGITIME RSRFEK                                                                                              1177
WP_001040087  1113  -NSD KLIPRKT-KDIYL-DPKKYGGFDSPIVAYSV-LVVAD--IK--KGKAQKLKTVTELLGITIME RSRFEK                                                                                              1177
WP_001040088  1113  -NSD KLIPRKT-KDIYL-DPKKYGGFDSPIVAYSV-LVVAD--IK--KGKAQKLKTVTELLGITIME RSRFEK                                                                                              1177
```

```
WP_001040089  1113  -NSD  KLIPRKT-KDIYL-DPKKYGGFDSPIVAYSV-LVVAD--IK--KGKAQKLKTVTELLGITIME  RSRFEK  1177
WP_001040090  1113  -NSD  KLIPRKT-KDIYL-DPKKYGGFDSPIVAYSV-LVVAD--IK--KGKAQKLKTVTELLGITIME  RSRFEK  1177
WP_001040091  1113  -NSD  KLIPRKT-KDIYL-DPKKYGGFDSPIVAYSV-LVVAD--IK--KGKAQKLKTVTELLGITIME  RSRFEK  1177
WP_001040092  1113  -NSD  KLIPRKT-KDIYL-DPKKYGGFDSPIVAYSV-LVLAD--IK--KGKAQKLKTVTELLGITIME  RSRFEK  1177
WP_001040094  1113  -NSD  KLIPRKT-KDIYL-DPKKYGGFDSPIVAYSV-LVVAD--IK--KGKAQKLKTVKELLGITIME  RSRFEK  1177
WP_001040095  1113  -NSD  KLIPRKT-KDIYL-DPKKYGGFDSPIVAYSV-LVVAD--IK--KGKAQKLKTVTELLGITIME  RSRFEK  1177
WP_001040096  1113  -NSD  KLIPRKT-KDIYL-DPKKYGGFDSPIVAYSV-LVVAD--IK--KGKAQKLKTVTELLGITIME  RSRFEK  1177
WP_001040097  1113  -NSD  KLIPRKT-KDIYL-DPKKYGGFDSPIVAYSV-LVVAD--IK--KGKAQKLKTVTELLGITIME  RSRFEK  1177
WP_001040098  1113  -NSD  KLIPRKT-KDIYL-DPKKYGGFDSPKVAYSV-LVVAD--IK--KGKAQKLKTVTELLGITIME  RSRFEK  1177
WP_001040099  1113  -NSD  KLIPRKT-KDIYL-DPKKYGGFDSPIVAYSV-LVVAD--IK--KGKAQKLKTVTELLGITIME  RSRFEK  1177
WP_001040100  1113  -NSD  KLIPRKT-KDIYL-DPKKYGGFDSPIVAYSV-LVVAD--IK--KGKAQKLKTVTELLGITIME  RERFEK  1177
WP_001040104  1113  -NSD  KLIPRKT-KDIYL-DPKKYGGFDSPIVAYSV-LVVAD--IK--KGKAQKLKTVTELLGITIME  RSRFEK  1177
WP_001040105  1113  -NSD  KLIPRKT-KDIYL-DPKKYGGFDSPIVAYSV-LVVAD--IK--KGKAQKLKTVTELLGITIME  RSRFEK  1177
WP_001040106  1113  -NSD  KLIPRKT-KDIYL-DPKKYGGFDSPIVAYSV-LVVAD--IK--KGKAQKLKTVTELLGITIME  RPRFEK  1177
WP_001040107  1113  -NSD  KLIPRKT-KDIYL-DPKKYGGFDSPIVAYSV-LVVAD--IK--KGKAQKLKTVTELLGITIME  RPRFEK  1177
WP_001040108  1113  -NSD  KLIPRKT-KDIYL-DPKKYGGFDSPIVAYSV-LVVAD--IK--KGKAQKLKTVTELLGITIME  RPRFEK  1177
WP_001040109  1113  -NSD  KLIPRKT-KDIYL-DPKKYGGFDSPIVAYSV-LVVAD--IK--KGKAQKLKTVTELLGITIME  RPRFEK  1177
WP_001040110  1113  -NSD  KLIPRKT-KDIYL-DPKKYGGFDSPIVAYSV-LVLAD--IK--KGKAQKLKTVTELLGITIME  RPRFEK  1177
WP_015058523  1113  -NSD  KLIPRKT-KDIYL-DPKKYGGFDSPIVAYSV-LVLAD--IK--KGKAQKLKTVTELLGITIME  RERFEK  1177
WP_017643650  1113  -NSD  KLIPRKT-KDIYL-DPKKYGGFDSPIVAYSV-LVVAD--IK--KGKAQKLKTVTELLGITIME  RSRFEK  1177
WP_017647151  1113  -NSD  KLIPRKT-KDIYL-DPKKYGGFDSPIVAYSV-LVVAD--IK--KGKAQKLKTVTELLGITIME  RSRFEK  1177
WP_017648376  1113  -NSD  KLIPRKT-KDIYL-DPKKYGGFDSPIVAYSV-LVVAD--IK--KGKAQKLKTVTELLGITIME  RSRFEK  1177
WP_017649527  1113  -NSD  KLIPRKT-KDIYL-DPKKYGGFDSPIVAYSV-LVVAD--IK--KGKAQKLKTVTELLGITIME  RSRFEK  1177
WP_017771611  1113  -NSD  KLIPRKT-KDIYL-DPKKYGGFDSPIVAYSV-LVVAD--IK--KGKAQKLKTVTELLGITIME  RPRFEK  1177
WP_017771984  1113  -NSD  KLIPRKT-KDIYL-DPKKYGGFDSPIVAYSV-LVAAD--IK--KGKAQKLKTVTELLGITIME  RSRFEK  1177
CFQ25032      1113  -NSD  KLIPRKT-KDIYL-DPKKYGGFDSPIVAYSV-LVVAD--IK--KGKAQKLKTVTELLGITIME  RSRFEK  1177
CFV16040      1113  -NSD  KLIPRKT-KDIYL-DPKKYGGEDSPIVAYSV-LVLAD--IK--KGKAQKLKTVTELLGITIME  RSRFEK  1177
KLJ37842      1113  -NSD  KLIPRKT-KDIYL-DPKKYGGFDSPIVAYSV-LVVAD--IK--KGKAQKLKTVTELLGITIME  RSRFEK  1177
KLJ72361      1127  -NSD  KLIPRKT-KDIYL-DPKKYGGFDSPIVAYSV-LVVAD--IK--KGKAQKLKTVTELLGITIME  RSRFEK  1191
KLL20707      1113  -NSD  KLIPRKT-KDIYL-DPKKYGGFDSPIVAYSV-LVVAD--IK--KGKAQKLKTVTELLGITIME  RPRFEK  1177
KLL42645      1113  -DSS  ENLVGVK-RNL---DPKKYGYAGISNSYAV-LVKAI--IE--KGVKKKETMVLEFQGISILD  RITFEK  1177
WP_047207273  1123  -ESD  KLIPRKT-KNSYW-NPKKYGGFDSPVVAYSI-LVFAD--VE--KGKSKKLRKVQDMVGITIME  KKRFEK  1185
WP_047209694  1095  -ESD  KLIPRKT-KNSYW-NPKKYGGFDSPVVAYSI-LVFAD--VE--KGKSKKLRKVQDMVGITIME  KKRFEK  1159
WP_049516684  1095  -ESD  KLIPRKT-KNSYW-NPKKYGGFDSPVVAYSI-LVFAD--VE--KGKSKKLRKVQDMVGITIME  KKRFEK  1159
GAD46167      1094  -ESD  KLIPRKT-KNSYW-NPKKYGGFDSPVVAYSI-LVFAD--VE--KGKSKKLRKVQDMVGITIME  KLRFEK  1158
WP_018363470  1126  -DSD  KLIPRKTkKV-LW-EPKKYGGEDSPTTVAYSI-LVVAK--VE--KGKTKKLKTVKELVGISIME  RSFFEK  1190
WP_003043819  1124  -ESA  KLIP----RKKGW-DTRKYGGFGSPTVAYSI-LVVAK--VE--KGKAKKLKSVKVLVGITIME  KGSYEK  1185
WP_006269658  1094  -ESD  KLIPRKT-KNSYW-DTRKYGGEDSPTVAYSI-LVFAD--VE--KGKSKKLRKVQDMVGITIME  KPRFEK  1158
WP_048800889  1114  -DSD  KLIARKTkEN-YW-DTKKYGGEDSPTVAYSI-LVVAD--IK--KGKAKKLTVKELVGISIME  KPFFEK  1178
WP_012767106  1114  -SFD  KLIS----RKHRF-ESSKYGGEGSPTVTYSV-LVVAKsKVQ--DGKVKKIKTGKELIGMTLLD  KLVFEK  1177
WP_014612333  1114  -SFD  KLIS----RKHRF-ESSKYGGEGSPTVTYSV-LVVAKsKVQ--DGKVKKIKTGKELIGTLLD  KLVFEK  1177
WP_015017095  1114  -SFD  KLIS----RKHRF-ESSKYGGEGSPTVTYSV-LVVAKsKVQ--DGKVKKIKTGKELIGTLLD  KLVFEK  1177
WP_015057649  1114  -SFD  KLIS----RKHRF-ESSKYGGEGSPTVTYSV-LVVAKsKVQ--DGKVKKIKTGKELIGTLLD  KLVFEK  1177
AHN30376      1113  -NSD  KLIPRKT-KDIYL-DPKKYGGFDSPIVAYSV-LVVAD--IK--KGKAQKLKTVTELLGITIME  RSRFEK  1177
EA078426      1113  -NSD  KLIPRKT-KDIYL-DPKKYGGFDSPIVAYSV-LVVAD--IK--KGKAQKLKTVTELLGITIME  RSRFEK  1177
CCW42055      1113  -NSD  KLIPRKT-KDIYL-DPKKYGGFDSPIVAYSV-LVVAD--IK--KGKAQKLKTVTELLGITIME  RSRFEK  1177
WP_003041502  1113  -NSD  KLIPRKT-KDIYL-DPKKYGGFDSPIVAYSV-LVVAD--IK--KGKAQKLKTVTELLGITIME  RSRFEK  1177
WP_037593752  1113  -NSD  KLIPRKT-KDIYL-DPKKYGGFDSPIVAYSV-LVVAD--IK--KGKAQKLKTVTELLGITIME  RSRFEK  1177
WP_050198062  1113  -NSD  KLIPRKT-KDIYL-DPKKYGGFDSPIVAYSV-LVVAD--IK--KGKAQKLKTVTELLGITIME  RSRFEK  1177
WP_050201642  1113  -NSD  KLIPRKT-KDIYL-DPKKYGGFDSPIVAYSV-LVVAD--IK--KGKAQKLKTVTELLGITIME  RSRFEK  1177
WP_050204027  1113  -NSD  KLIPRKT-KDIYL-DPKKYGGFDSPIVAYSV-LVVAD--IK--KGKAQKLKTVTELLGITIME  RSRFEK  1177
WP_050881965  1113  -NSD  KLIPRKT-KDIYL-DPKKYGGFDSPIVAYSV-LVVAD--IK--KGKAQKLKTVTELLGITIME  RSRFEK  1177
WP_050886065  1113  -NSD  KLIPRKT-KDIYL-DPKKYGGFDSPIVAYSV-LVVAD--IK--KGKAQKLKTVTELLGITIME  RSRFEK  1177
```

```
WP_048327215  1114  -SFD KLIS----RKHRF-ESSKYGGEGSPTVTYSV-LVVAkcKVQ--DGKVKKIKTGKELIGITLLD KLVFEK  1177
WP_049519324  1114  -SFD KLIS----RKHRF-ESSKYGGEGSPTVTYSV-LVVAksKVQ--DGKVKKIKTGKELIGITLLD KLVFEK  1177
WP_012515931  1095  -NSD KLIP----RKNNW-DTRKYGGFDSPTVAYSV-LVIAK--ME--KGKAKVLKPVKEMVGITIME RTAFEE  1156
WP_021320964  1095  -NSD KLIP----RKNNW-DTRKYGGFDSPTVAYSV-LVIAK--ME--KGKAKVLKPVKEMVGITIME RTAFEE  1156
WP_037581760  1095  -NSD KLIP----RKNNW-DTRKYGGFDSPTVAYSV-LVIAK--ME--KGKAKVLKPVKEMVGITIME RIAFEE  1156
WP_044232481  1124  -DSD KLIPRKTkKL-QM-ETQKYGGEDSPTVAYSV-LVVAD--VE--KGKTRKLKTVKELVGISIME RSFFEE  1188
WP_009854540  1119  -DSD KLIPRKTkKV-YW-DTKKYGGEDSPTVAYSV-FVVAD--VE--KGKAKKLKTVKELVGISIME RSFFEE  1183
WP_012962174  1121  -NSD KLIPRKTkKF-RW-DTPKYGGEDSPNIAYSV-FVIAD--VE--KGKAKKLKTVKELVGISIME RSFFEE  1184
WP_039695303  1124  -DSD KLIPRKTkKV-YW-DTKKYGGFDSPTVAYSV-FVVAD--VE--KGKAKKLKTVKELVGISIME RSFFEE  1185
WP_014334983  1115  -DSD KLIA----RKKSW-NTKKYGGFDSPIVAYSV-LVVAD--IE--KGKAKKLKTVKELVGIKIME QDEFEK  1188
WP_003099269  1115  -DSD KLIA----RKKSW-DPKKYGGFDSPIIAYSV-LVVAK--IA--KGKTQKLKTIKELVGIKIME QDEFEK  1176
AHY15608      1115  -DSD KLIA----RKKSW-DPKKYGGFDSPIIAYSV-LVVAK--IA--KGKTQKLKTIKELVGIKIME QDEFEK  1176
AHY17476      1     -M-- ---- ----------------------------------------------------------ME----  8
ESR09100      1115  -DSD KLIA----RKKSW-DPKKYGGFDSPIIAYSV-LVVAK--IA--KGKTQKLKTIKELVGIKIME QDEFEK  1176
AGM98575      1094  -NSD KLIPRKT-KKFYW-DTKKYGGFDSPIVAYSI-LVIAD--IE--KGKSKKKLKLVKDLVGITIME RTIFEK  1158
ALF27331      1109  -NN- KLIP----RKKDW-SVDKYGGFIEPAESYSLaIFYTD-IN---GKKPKKKSTIIAISRME KKDYEK  1167
WP_018372492  1125  vvDAS KLTPIKS-G---L-SPEKYGGYARPTIAYSV-LVIAD--IE--KGKAKKLKRIKEMVGITVQD KKKFEA  1188
WP_045618028  1119  -NSD KLIPRKT-KDILL-DTTKYGGFDSPVIAYSI-LLIAD--IE--KGKAKKKLKTVKTLVGITIME KAAFEE  1183
WP_045635197  1094  -NSD KLIPRKT-KKFYW-DTKKYGGFDSPIVAYSI-LVIAD--IE--KGKSKKLKTVKALVGVTIME KMTFER  1158
WP_002263549  1094  -NSD KLIPRKT-KKFYW-DTKKYGGFDSPIVAYSI-LVIAD--IE--KGKSKKLKTVKALVGVTIME KMTFER  1158
WP_002263887  1094  -DSD KLIPRKT-KKFYW-DTKKYGGFDSPIVAYSI-LVIAD--IE--KGKSKKLKTVKALVGVTIME KMTFER  1158
WP_002264920  1094  -NSD KLIPRKT-KKFYW-DTKKYGGFDSPIVAYSI-LVIAD--IE--KGKSKKLKTVKALVGVTIME KMTFER  1158
WP_002269043  1094  -NSD KLIPRKT-KKFYW-DTKKYGGFDSPIVAYSI-LVIAD--IE--KGKSKKLKTVKALVGVTIME KMTFER  1158
WP_002269448  1094  -NSD KLIPRKT-KKFYW-DTKKYGGFDSPIVAYSI-LVIAD--IE--KGKSKKLKTVKALVGVTIME KMTFER  1158
WP_002271977  1094  -NSD KLIPRKT-KKFYW-DTKKYGGFDSPIVAYSI-LVIAD--IE--KGKSKKLKTVKALVGVTIME KMTFER  1158
WP_002272766  1094  -NSD KLIPRKT-KKFYW-DTKKYGGFDSPIVAYSI-LVIAD--IE--KGKSKKLKTVKALVGVTIME KMTFER  1158
WP_002273241  1094  -NSD KLIPRKT-KKFYW-DTKKYGGFDSPIVAYSI-LVIAD--IE--KGKSKKLKTVKALVGVTIME KMTFER  1158
WP_002275430  1094  -NSD KLIPRKT-KKFYW-DTKKYGGFDSPIVAYSI-LVIAD--IE--KGKSKKLKTVKALVGVTIME KMTFER  1158
WP_002276448  1094  -NSD KLIPRKT-KKFYW-DTKKYGGFDSPIVAYSI-LVIAD--IE--KGKSKKLKTVKALVGVTIME KMTFER  1158
WP_002277050  1112  -PLE KLVPLKK---AL-NPEKYGGYQKPTTAYPI-LLIVD------------TKQLIPISVMD KKRFEQ  1166
WP_002773364  1094  -NSD KLIPRKT-KKFYW-DTKKYGGFDSPIVAYSI-LVIAD--IE--KGKSKKLKTVKALVGVTIME KMTFER  1158
WP_002822247  1112  -PLE KLVPLKK---AL-NPEKYGGYQKPTTAYPI-LLIVD------------TKQLIPISVMD KKRFEQ  1166
WP_002779025  1094  -NSD KLIPRKT-KKFYW-DTKKYGGFDSPIVAYSI-LVIAD--IE--KGKSKKLKTVKALVGVTIME KMTFER  1158
WP_002282906  1094  -NSD KLIPRKT-KKFYW-DTKKYGGFDSPIVAYSI-LVIAD--IE--KGKSKKLKTVKALVGVTIME KMTFER  1158
WP_002798859  1094  -DSD KLIPRKT-KKFYW-DTKKYGGFDSPIVAYSI-LVIAD--IE--KGKSKKLKTVKALVGVTIME KMTFER  1158
WP_002283846  1094  -NSD KLIPRKT-KKFYW-DTKKYGGFDSPIVAYSI-LVIAD--IE--KGKSKKLKTVKALVGVTIME KMTFER  1158
WP_002800230  1094  -NSD KLIPRKT-KKFYW-DTKKYGGFDSPIVAYSI-LVIAD--IE--KGKSKKLKTVKALVGVTIME KMTFER  1158
WP_002283255  1094  -NSY KLIPRKT-KKFYW-DTKKYGGFDSPIVAYSI-LVIAD--IE--KGKSKKLKTVKALVGVTIME KMTFER  1158
WP_002816696  1094  -NSD KLIPRKT-KKFYW-DTKKYGGFDSPIVAYSI-LVIAD--IE--KGKSKKLKTVKALVGVTIME KMTFER  1158
WP_002288990  1094  -DSD KLIPRKT-KKFYW-DTKKYGGFDSPIVAYSI-LVIAD--IE--KGKSKKLKTVKALVGVTIME KMTFER  1158
WP_002289641  1094  -NSD KLIPRKT-KKFYW-DTKKYGGFDSPIVAYSI-LVIAD--IE--KGKSKKLKTVKALVGVTIME KMTFER  1158
WP_002290427  1094  -DSD KLIPRKT-KKFYW-DTKKYGGFDSPIVAYSI-LVIAD--IE--KGKSKKLKTVKALVGVTIME KMTFER  1158
WP_002957753  1094  -NSD KLIPRKT-KKFYW-DTKKYGGFDSPIVAYSI-LVIAD--IE--KGKSKKLKTVKALVGVTIME KMTFER  1158
WP_002969423  1094  -NSD KLIPRKT-KKFYW-DTKKYGGFDSPIVAYSI-LVIAD--IE--KGKSKKLKTVKALVGVTIME KMTFER  1158
WP_003044487  1108  -NSD KLIPRKT-KKFYW-DTKKYGGFDSPIVAYSI-LVIAD--IE--KGKSKKLKTVKALVGVTIME KMTFER  1172
WP_002305844  1094  -NSD KLIPRKT-KKFYW-DTKKYGGFDSPIVAYSI-LVIAD--IE--KGKSKKLKTVKALVGVTIME KMTFER  1158
WP_003072203  1094  -NSD KLIPRKT-KKFYW-DTKKYGGFDSPIVAYSI-LVIAD--IE--KGKSKKLKTVKALVGVTIME KMTFER  1158
WP_002310390  1094  -DSD KLIPRKT-KKFYW-DTKKYGGFDSPIVAYSI-LVIAD--IE--KGKSKKLKTVKALVGVTIME KMTFER  1158
WP_002352408  1094  -NSD KLIPRKT-KKFYW-DTKKYGGFDSPIVAYSI-LVIAD--IE--KGKSKKLKTVKALVGVTIME KMTFER  1158
WP_012997688  1094  -NSD KLIPRKT-KKFYW-DTKKYGGFDSPIVAYSI-LVIAD--IE--KGKSKKLKTVKALVGVTIME KMTFER  1158
WP_014677909  1094  -NSD KLIPRKT-KKFYW-DTKKYGGFDSPIVAYSI-LVIAD--IE--KGKSKKLKTVKALVGVTIME KMTFER  1158
WP_019312892  1094  -NSD KLIPRKT-KKFYW-DTKKYGGFDSPIVAYSI-LVIAD--IE--KGKSKKLKTVKALVGVTIME KMTFER  1158
WP_019313659  1094  -NSD KLIPRKT-KKFYW-DTKKYGGFDSPIVAYSI-LVIAD--IE--KGKSKKLKTVKALVGVTIME KMTFER  1158
```

```
WP_019314093   1094  -NSD KLIPRKT-KKFYW-DTKKYGGFDSPIVAYSI-LVIAD--IE--KGKSKKLKTVKALVGVTIME KMTFER  1158
WP_019315370   1094  -NSD KLIPRKT-KKFYW-DTKKYGGFDSPIVAYSI-LVIAD--IE--KGKSKKLKTVKALVGVTIME KMTFER  1158
WP_019803776   1094  -NSD KLIPRKT-KKFYW-DTKKYGGFDSPIVAYSI-LVIAD--IE--KGKSKKLKTVKALVGVTIME KMTFER  1158
WP_019805234   1094  -DSD KLIPRKT-KKFYW-DTKKYGGFDSPIVAYSI-LVIAD--IE--KGKSKKLKTVKALVGVTIME KMTFER  1158
WP_024783594   1094  -NSD KLIPRKT-KKFYW-DTKKYGGFDSPIVAYSI-LVIAD--IE--KSKSKKLKTVKALVGVTIME KMTFER  1158
WP_024784288   1112  -PLE KLVPLKK----AL-NPEKYGGYQKPTTAYPI-LLIVD-------TKQLPISVMD KKRFEQ  1166
WP_024784666   1094  -NSD KLIPRKT-KKFYW-DTKKYGGFDSPIVAYSI-LVIAD--IE--KGKSKKLKTVKALVGVTIME KMTFER  1158
WP_024784894   1094  -NSD KLIPRKT-KKFYW-DTKKYGGFDSPIVAYSI-LVIAD--IE--KGKSKKLKTVKALVGVTIME KMTFER  1158
WP_024786433   1112  -PLE KLVPLKK----AL-NPEKYGGYQKPTTAYPI-LLIVD-------TKQLPISVMD KKRFEQ  1166
WP_049473442   1094  -NSD KLIPRKT-KKFYW-DTKKYGGFDSPIVAYSI-LVIAD--IE--KGKSKKLKTVKALVGVTIME KMTFER  1158
WP_049474547   1094  -NSD KLIPRKT-KKFYW-DTKKYGGFDSPIVAYSI-LVIAD--IE--KGKSKKLKTVKALVGVTIME KMTFER  1158
EMC03581       1087  -NSD KLIPRKT-KKFYW-DTKKYGGFDSPIVAYSI-LLIAD--IE--KGKAKRLKTVKTLVGITIME KATFEK  1151
WP_000428612   1122  -NSD KLIPRKT-KDILW-DTTKYGGFDSPVIAYSI-LLIAD--IE--KGKAKKLKTVKTLVGITIME KAAFEE  1186
WP_000428613   1120  -NSD KLIPRKT-KDILW-ETTKYGGFDSPVIAYSI-LLIAD--IE--KGKAKKLKTVKTLVGITIME KAAFEE  1184
WP_049523028   1115  -NSD KLIPRKT-KNVQL-DTTKYGGFDSPIIAYSV-LVVAK--VT--KGKSQKTKSVKELVGITIME KVKFEA  1179
WP_003107102   1084  -DSD KLIP----RKNNW-DPKKYGGFGSPIIAYSV-LVVAK--VT--KGKSQKTKSVKELVGITIME QNEFEK  1145
WP_054279288   1116  -KSS KLIP----RKNKWrDTTKYGGFNTPTVAYSV-LVVAK--VE--KGKAKKLKPVKELVGITIME RTKFEA  1178
WP_049531101   1125  vvDAS KLIPIKS-G---L-SPEKYGGYARPTIAYSV-LVIAD--IE--KGKAKKLKRIKEMVGITIQD KKKFEA  1188
WP_049538452   1125  vvDAS KLIPIKS-G---L-SPEKYGGYARPTIAYSV-LVIAD--IE--KGKTKKLKRIKEMIGITVQD KKIFES  1188
WP_049549711   1127  vvDAS KLIPIKS-G---L-SPEKYGGYARPTIAYSV-LVIAD--IE--KGKTKKLKRIKEMVGITIQD KKKFEA  1190
WP_007896501   1121  -NSD KLIE----DPKKYGGFDSPNTAYSI-FVVAK--VA--KRKAQKLKTVKEIVGITIME QAEYEK  1182
EFR44625       1073  -NSD KLIE----RKKGW-DPKKYGGFDSPNTAYSI-FVVAK--VA--KRKAQKLKTVKEIVGITIME QAEYEK  1134
WP_002897477   1119  -NSD KLIPRKT-KDILW-DTTKYGGFDSPVIAYSI-LVIAD--IE--KGKAKKLKTVKTLVGITIME KAAFEE  1183
WP_002906454   1124  vvDAS KLIPIKS-S---L-SPEKYGGYARPTIAYSV-LVIAD--IE--IEkGKGAKKLKRIKEIVGITIQD KKKFES  1189
WP_009729476   1120  -NSD KLIPRKT-KDILW-DTTKYGGFDSPVIAYSI-LLIAD--IE--KGKAKKLKTVKTLVGITIME KDAFEK  1184
CQR24647       1110  -GSD KLIARKT-KNNYL-STQKYGGFDSPTVAYSI-MFVAD--IE--KGKSRLKTVKEMIGITIME RSRFES  1174
WP_000066813   1124  -NSD KLIPRKT-KEILW-DTTKYGGFDSPVIAYSI-LLIAD--IE--KGKAKKLKTVKTLVGITIME KATFEK  1188
WP_009754323   1120  -NSD KLIPRKT-KDILW-DTTKYGGFDSPVIAYSI-LLIAD--IE--KGKAKKLKTVKTLVGITIME KAAFEK  1184
WP_044674937   1113  -DSD KLIPRKT-EKFYL-DTKKYGGFDSPTIAYSV-LLIAD--IE--KGKAKKLKRVKELIGITIME RMAFEK  1177
WP_044676715   1115  -DSD KLIPRKT-EKFYL-DTKKYGGFDSPTIAYSV-LLIAD--IE--KGKAKKLKRVKELIGITIME RMAFEK  1179
WP_044680361   1115  -DSD KLIPRKT-EKFYL-DTKKYGGFDSPTIAYSV-LLIAD--IE--KGKAKKLKRVKELIGITIME RMAFEK  1179
WP_044681799   1113  -DSD KLIPRKT-EKFYL-DTKKYGGFDSPTIAYSV-LLIAD--IE--KGKAKKLKRVKELIGITIME RMAFEK  1177
WP_049533112   1123  -DSS ENLVGVK-RNL--DPKKYGGYAGISNSYAV-LVKA1--IE--KGVKKKETMVLEFQGISILD RITFEK  1185
WP_029090905   1062  -SSS KTIP----LKKHL-DTAIYGGYTAVNYASYA---LIQ--FK---KGRKLK--REIIGIPLAV QTRIDN  1117
WP_006506696   1085  haDKG AVVP----vNKNRS-DVHKYGGFPSG--LQYTI----VA--IEggKKKGKKTELVKKISGVPLHL KAASIN  1149
AIT42264       1115  KRIA----IKNNL-DPNIYGGYIEEKMAYYI---AInyLE--NGKTKK---AIVGISIKD RSSFEK  1176
WP_034440723   1093  k-KTE KRIP----IKNNL-DPNIYGGYIEEKMAYYI---AInyLE--NGKTKK---AIVGISIKD KDFEG  1149
AKQ21048       1115  -NSD KLIA----RKKDW-DPKKYGGFDSPTVAYSV-LVVAK--VE--KGKSKKLKSVKELLGITIME RSSFEK  1176
WP_004636532   1093  -DSS KLIP----VKEGM-DPQKYGGLSQVSEAFAV-VIT----HE--KGKKKQLK--SDLISIPIVD QKAYEQ  1150
WP_002364836   1099  -PSN KLIP----VKNGL-DPQKYGGFDSPVVAYTV-LF----T--HE--KGK-KPL-IKQEILGITIME KTRFEQ  1156
WP_016631044   1050  -PSN KLIP----VKNGL-DPQKYGGFDSPVVAYTV-LF----T--HE--KGK-KPL-IKQEILGITIME KTRFEQ  1107
EMS75795       835   -KPD KLIQ----RKAGW-DVSKYGGFGSPVVAYAV-AFI----YE--KGKAR--KKAKAIEGITIME QSLFEQ  892
WP_002373311   1099  -PSN KLIP----VKNGL-DPQKYGGFDSPVVAYTV-LF----T--HE--KGK-KPL-IKQEILGITIME KTRFEQ  1156
WP_002378009   1099  -PSN KLIP----VKNGL-DPQKYGGFDSPVVAYTV-LF----T--HE--KGK-KPL-IKQEILGITIME KTRFEQ  1156
WP_002407324   1099  -PSN KLIP----VKNGL-DPQKYGGFDSPVVAYTV-LF----T--HE--KGK-KPL-IKQEILGITIME KTRFEQ  1156
WP_002413717   1101  -PSN KLIP----VKNGL-DPQKYGGFDSPVVAYTV-LF----T--HE--KGK-KPL-IKQEILGITIME KDFEG  1158
WP_010775580   1099  -PSN KLIP----VKNGL-DPQKYGGFDSPVVAYTV-LF----T--HE--KGK-KPL-IKQEILGITIME KTRFEQ  1156
WP_010818269   1099  -PSN KLIP----VKNGL-DPQKYGGFDSPVVAYTV-LF----T--HE--KGK-KPL-IKQEILGITIME KTRFEQ  1156
WP_010824395   1099  -PSN KLIP----VKNGL-DPQKYGGFDSPVVAYTV-LF----T--HE--KGK-KPL-IKQEILGITIME KTRFEQ  1156
WP_016622645   1099  -PSN KLIP----VKNGL-DPQKYGGFDSPVVAYTV-LF----T--HE--KGK-KPL-IKQEILGITIME KTRFEQ  1156
WP_033624816   1099  -PSN KLIP----VKNGL-DPQKYGGFDSPVVAYTV-LF----T--HE--KGK-KPL-IKQEILGITIME KTKFEQ  1156
WP_033625576   1099  -PSN KLIP----VKNGL-DPQKYGGFDSPVVAYTV-LF----T--HE--KGK-KPL-IKQEILGITIME KTRFEQ  1156
WP_033789179   1099  -PSN KLIP----VKNGL-DPQKYGGFDSPVVAYTV-LF----T--HE--KGK-KPL-IKQEILGITIME KTRFEQ  1156
```

-continued

| | | | | | | |
|---|---|---|---|---|---|---|
| WP_002310644 | 1101 | -DSS KLLP----RKNNW-DPAKYGGLGSPNVAYTV-AFT-----YE--KGKAR--KRTNALEGITIME REAFEQ | 1158 |
| WP_002312694 | 1102 | -DSS KLLP----RKNNW-DPAKYGGLGSPNVAYTV-AFT-----YE--KGKAR--KRTNALEGITIME REAFEQ | 1159 |
| WP_002314015 | 1102 | -DSS KLLP----RKNNW-DPAKYGGLGSPNVAYTV-AFT-----YE--KGKAR--KRTNALEGITIME REAFEQ | 1159 |
| WP_002320716 | 1102 | -DSS KLLP----RKNNW-DPAKYGGLGSPNVAYTV-AFT-----YE--KGKAR--KRTNALEGITIME REAFEQ | 1159 |
| WP_002330729 | 1101 | -DSS KLLP----RKNNW-DPAKYGGLGSPNVAYTV-AFT-----YE--KGKAR--KRTNALEGITIME REAFEQ | 1158 |
| WP_002335161 | 1102 | -DSS KLLP----RKNNW-DPAKYGGLGSPNVAYTV-AFT-----YE--KGKAR--KRTNALEGITIME REAFEQ | 1159 |
| WP_002345439 | 1102 | -DSS KLLP----RKNNW-DPTKYGGLGSPNVAYTV-AFT-----YE--KGKAR--KRTNALEGITIME REAFEQ | 1159 |
| WP_034867970 | 1092 | -KPD KLIE----RKNNW-DVTKYGGFGSPVIAYAI-AFV-----YA--KGKTQ--KKTRAIEGITIME QAAFEK | 1149 |
| WP_047937432 | 1102 | -DSS KLLP----RKNNW-DPAKYGGLGSPNVAYTV-AFT-----YE--KGKAR--KRTNALEGITIME REAFEQ | 1159 |
| WP_010720994 | 1092 | -KPD KLIE----RKNNW-DVTKYGGFGSPVIAYAI-AFV-----YA--KGKTQ--KKTRAIEGITIME QAAFEK | 1149 |
| WP_010737004 | 1092 | -KPD KLIE----RKNNW-DVTKYGGFGSPVIAYAI-AFV-----YA--KGKTQ--KKTRAIEGITIME QAAFEK | 1149 |
| WP_034700478 | 1092 | -KPD KLIE----RKNNW-DVTKYGGFGSPVIAYAI-AFV-----YA--KGKTQ--KKTRAIEGITIME QAAFEK | 1149 |
| WP_007209003 | 1090 | -ESQ KLIR----RKQQW-NTKKYGGFDSPVVAYAI--LLS----FD--KGK-RKARSFK-IVGITIQD RESFEG | 1147 |
| WP_023351917 | 1086 | -NPE KLIP----RKASL-DPLKYGGYGSPLVAYTV-IFI-----FE--KGKQK--KVTKGIEGITVME QLRFEQ | 1143 |
| WP_010770040 | 1097 | -DSD KLIS----RKTNW-SPKLYGGFDSPQVAYSV-II--T---YE--KGK-KKVRA-KAIVGITIME QSLFKK | 1154 |
| WP_048604708 | 1094 | -DSD KLIS----RKKEW-DPTKYGGFDSPNMAYAV-II--R---YE--KGK-TRKLV-KTIVGITIME RAAFEK | 1151 |
| WP_010750235 | 1095 | -KPD KLIK----RKNNW-DVTKYGGFGSPVVAYAV-VFT-----YE--KGKNH--KKAKAIEGITIME QALFEK | 1152 |
| AII16583 | 1154 | -NSD KLIA----RKKDW-DPKKYGGFDSPTVAYSV-LVVAK---VE--KGKSKKLKSVKELLGITIME RSSFEK | 1215 |
| WP_029073316 | 1100 | hsEKG AKVP----vNKLRS-NVHKYGGFEG--LKYSI-----VA--IKgkKKKGKKIIDVNKLVGIPLMY KNVDDE | 1164 |
| WP_031589969 | 1100 | nsDKD ATVP----vNKYRS-NVHKYGGFSG--VNSFI-----VA--IKgkKKKGKKVIEVNKLTGIPLMY KNADEE | 1164 |
| KDA45870 | 1079 | -DSG KLLP----RKEGL-DPVKYGGYAKAVESYAV-LITAD-eVK-KGKTKKVKT---LVNIPIID SKKYEA | 1138 |
| WP_039099354 | 1098 | k-ASG QLIPAKQdRPTAL----YGGYSGKTVAYMC---IVR--IKnkKGDLYKVCGVETSWLAQLKQ KKAFLK | 1170 |
| AKP02966 | 1119 | k------ QKKDM-DPNIYGGFSGDNKSSIT--IVK--ID----NNKIKPVA--IPIRLIN ----DK | 1172 |
| WP_010991369 | 1096 | -NSS KLTNW-DPMKYGGLDSPNMAYAV-VI--E---YA--KGK-NKLVFEKKIIRVTIME RKAFEK | 1154 |
| WP_033838504 | 1096 | -NSS KLIS----RKTNW-DPMKYGGLDSPNMAYAV-VI--E---YA--KGK-NKLVFEKKIIRVTIME RKAFEK | 1154 |
| EHN60060 | 1099 | -NSS KLIS----RKTNW-DPMKYGGLDSPNMAYAV-VI--E---YA--KGK-NKLVFEKKIIRVTIME RKAFEK | 1157 |
| EFR89594 | 865 | -NSS KLIS----RKTNW-DPMKYGGLDSPNMAYAV-VI--E---YA--KGK-NKLVFEKKIIRVTIME RVAFEK | 923 |
| WP_038409211 | 1096 | -NSS KLIS----RKADW-NPIKYGGFDGSNMAYSI-VI--E---YE--KRK-KKTVIKKELIQINIME RVAFEK | 1154 |
| EFR95520 | 715 | -NSS KLIS----RKADW-NPIKYGGFDGSNMAYSI-VI--E---YE--KRK-KKTVIKKELIQINIME RVAFEK | 773 |
| WP_003723650 | 1096 | -NSS KLIP----RKENW-DPMKYGGLDSPNMAYAV-II--E---HA--KGK-KKIVIEKKLIQINIME RKMFEK | 1154 |
| WP_003727705 | 1096 | -NSS KLIP----RKENW-DPMKYGGLDSPNMAYAV-II--E---HA--KGK-KKIVIEKKLIQINIME RKMFEK | 1154 |
| WP_003730785 | 1096 | -NSS KLIP----RKENW-DPMKYGGLDSPNMAYAV-II--E---HA--KGK-KKIVIEKKLIQINIME RKMFEK | 1154 |
| WP_003733029 | 1096 | -KSN KLIP----RKTNW-DPIKYGGFDGSKMAYAI-III--E---YE--KQK-RKVRIEKKLIQINIME REAFEK | 1154 |
| WP_003739838 | 1096 | -NSS KLIP----RKENW-DPMKYGGLDSPNMAYAV-II--E---HA--KGK-KKVFEKKIIRITIME RKAFEK | 1154 |
| WP_014601172 | 1096 | -NSS KLIP----RKENW-DPMKYGGLDSPNMAYAV-II--E---HA--KGK-KKLIPEKKIRITIME RKAFEK | 1154 |
| WP_023548323 | 1096 | -DSS KLIP----KKTNL-NPIKYGGFPEGSNMAYAI-II--E---HE--KRK-KKVTIEKKLIQINIME RKAFEK | 1154 |
| WP_031665337 | 1096 | -NSS KLIP----RKENW-DPMKYGGLDSPNMAYAV-II--E---HA--KGK-KRIVIEKKLIQINIME RKMFEK | 1154 |
| WP_031669209 | 1096 | -KSN KLIP----RKTNL-NPIKYGGFDGSKMAYAI-II--E---YE--KQK-RKVRIEKKLIQINIME REAFEK | 1154 |
| WP_033920898 | 1096 | -NSS KLIP----RKENW-DPMKYGGLDSPNMAYAI-II--E---HA--KGK-KKVTIEKKLIQINIME RKAFEK | 1154 |
| AKI42028 | 1099 | -NSS KLIP----KKTNL-NPIKYGGFPEGSNMAYAI-II--E---HE--KRK-KKLIPEKKIRITIME RKMFEK | 1157 |
| AKI50529 | 1099 | -DSS KLIP----KKTNL-NPIKYGGFDGSKMAYAI-III--E---HE--KRK-KKVTIEKKLIQINIME RKMFEK | 1157 |
| EFR83390 | 544 | -NSS KLIP----RKENW-DPMKYGGLDSPNMAYAV-II--E---HA--KGK-KKIVIEKKLIQINIME RKMFEK | 602 |
| WP_046323366 | 1096 | -NSD KLIA----RKADW-DPIKYGGFDGSNMAYAI-VI--E---HE--KRK-KGKSKKLKSVKELLGITIME RTAFEK | 1154 |
| AKE81011 | 1131 | -NSD KLIA AVIP----VNKYRK-DVNKYGGFSG--LQYVI----AA--IEgtKKKGKKLVKVRKLSGIPLYL KQADIK | 1192 |
| CU082355 | 1089 | hsAKG AVIP----VNKYRK-DVNKYGGFSG--LQYVI----AA--IEgtKKKGKKLVKVRKLSGIPLYL KQADIK | 1153 |
| WP_033162887 | 1090 | hsEKG ATVP----1NKYRA-DVHKYGGFGN--VQSII----VA--IEgkKKKGKKLIDVRKLTSIPLHL KNAPVE | 1154 |
| AGZ01981 | 1148 | -NSD KLIA----RKKDW-DPKKYGGFDSPTVAYSV-LVVAK---VE--KGKSKKLKSVKELLGITIME RSSFEK | 1209 |
| AKA60242 | 1115 | -NSD KLIA----RKKDW-DPKKYGGFDSPTVAYSV-LVVAK---VE--KGKSKKLKSVKELLGITIME RSSFEK | 1176 |
| AKS40380 | 1115 | -NSD KLIA----RKKDW-DPKKYGGFDSPTVAYSV-LVVAK---VE--KGKSKKLKSVKELLGITIME RSSFEK | 1176 |
| 4UN5_B | 1119 | -NSD KLIA----RKKDW-DPKKYGGFDSPTVAYSV-LVVAK---VE--KGKSKKLKSVKELLGITIME RSSFEK | 1180 |
| WP_010922251 | 1177 | NPI---DFLE--AKGYKE--V-KKDLIIK--LPKYSLFE---LENGRKRMLAS -d↑LQKGNELALPSKYVNFLYLA | 1239 |
| WP_039695303 | 1186 | NPV---EFLE--NKGYHN--I-REDKLIK--LPKYSLFE---FEGGRRRLLAS ASELQKGNEMVLPGYLVELLYHA | 1248 |
| WP_045635197 | 1184 | NPI---TFLE--NKGYHN--V-RKENILC--LPKYSLFE---LENGRRRLLAS AKELQKGNEIVLPVYLITLLYHS | 1246 |

| | | | | | |
|---|---|---|---|---|---|
| 5AXW_A | 913 | KPYrfdVYLD---NGVVKFvtV-KNLDVIK---KENYYE---VNSKAYEEAKK | -KKISNQAEFIASFYNNDLIKIN | | 978 |
| WP_009880683 | 861 | DPV----DFLE---AKGYKE--V-RKDLIIK--LPKYSLFE--LENGRKRMLAS | -GELQKGNELALPSKYVNFLYLA | | 923 |
| WP_010922251 | 1177 | NPI----DFLE---AKGYKE--V-RKDLIIK--LPKYSLFE--LENGRKRMLAS | -GELQKGNELALPSKYVNFLYLA | | 1239 |
| WP_011054416 | 1177 | DPI----DFLE---AKGYKE--V-RKDLIVK--LPKYSLFE--LENGRKRMLAS | -GELQKGNELALPSKYVNFLYLA | | 1239 |
| WP_011284745 | 1177 | NPI----DFLE---AKGYKE--V-RKDLIIK--LPKYSLFE--LENGRKRMLAS | -GELQKGNELALPSKYVNFLYLA | | 1239 |
| WP_011285506 | 1177 | NPI----DFLE---AKGYKE--V-KKDLIIK--LPKYSLFE--LENGRKRMLAS | -GELQKGNELALPSKYVNFLYLA | | 1239 |
| WP_011527619 | 1177 | DPV----DFLE---AKGYKE--V-RKDLIIK--LPKYSLFE--LENGRKRMLAS | -GELQKGNELALPSKYVNFLYLA | | 1239 |
| WP_012560673 | 1177 | NPI----DFLE---AKGYKE--V-KKDLIIK--LPKYSLFE--LENGRKRMLAS | -GELQKGNELALPSKYVNFLYLA | | 1239 |
| WP_014407541 | 1176 | NPI----DFLE---AKGYKE--V-RKDLIIK--LPKYSLFE--LENGRKRMLAS | -GELQKGNELALPSKYVNFLYLA | | 1238 |
| WP_020905136 | 1177 | NPI----DFLE---AKGYKE--V-KKDLIIK--LPKYSLFE--LENGRKRMLAS | -GELQKGNELALPSKYVNFLYLA | | 1239 |
| WP_023080005 | 1176 | NPI----DFLE---AKGYKE--V-RKDLIIK--LPKYSLFE--LENGRKRMLAS | -GELQKGNELALPSKYVNFLYLA | | 1238 |
| WP_023610282 | 1176 | NPI----DFLE---AKGYKE--V-RKDLIIK--LPKYSLFE--LENGRKRMLAS | -GELQKGNELALPSKYVNFLYLA | | 1238 |
| WP_030125963 | 1177 | NPI----DFLE---AKGYKE--V-RKDLIIK--LPKYSLFE--LENGRKRMLAS | -GELQKGNELALPSKYVNFLYLA | | 1239 |
| WP_030126706 | 1177 | NPI----DFLE---AKGYKE--V-RKDLIIK--LPKYSLFE--LENGRKRMLAS | -GELQKGNELALPSKYVNFLYLA | | 1239 |
| WP_031488318 | 1177 | NPI----DFLE---AKGYKE--V-RKDLIIK--LPKYSLFE--LENGRKRMLAS | -GELQKGNELALPSKYVNFLYLA | | 1239 |
| WP_032460140 | 1177 | DPV----DFLE---AKGYKE--V-RKDLIIK--LPKYSLFE--LENGRKRMLAS | -GELQKGNELALPSKYVNFLYLA | | 1239 |
| WP_032461047 | 1177 | DPV----DFLE---AKGYKE--V-RKDLIIK--LPKYSLFE--LENGRKRMLAS | -GELQKGNELALPSKYVNFLYLA | | 1239 |
| WP_032462016 | 1177 | NPI----DFLE---AKGYKE--V-RKDLIIK--LPKYSLFE--LENGRKRMLAS | -GELQKGNELALPSKYVNFLYLA | | 1239 |
| WP_032462936 | 1177 | NPI----DFLE---AKGYKE--V-RKDLIIK--LPKYSLFE--LENGRKRMLAS | -GELQKGNELALPSKYVNFLYLA | | 1239 |
| WP_032464890 | 1177 | NPI----DFLE---AKGYKE--V-RKDLIIK--LPKYSLFE--LENGRKRMLAS | -GELQKGNELALPSKYVNFLYLA | | 1239 |
| WP_033888930 | 1002 | NPI----DFLE---AKGYKE--V-KKDLIIK--LPKYSLFE--LENGRKRMLAS | -GELQKGNELALPSKYVNFLYLA | | 1064 |
| WP_038431314 | 1177 | NPI----DFLE---AKGYKE--V-RKDLIIK--LPKYSLFE--LENGRKRMLAS | -GELQKGNELALPSKYVNFLYLA | | 1239 |
| WP_038432938 | 1176 | NPI----DFLE---AKGYKE--V-RKDLIIK--LPKYSLFE--LENGRKRMLAS | -GELQKGNELALPSKYVNFLYLA | | 1238 |
| WP_038434062 | 1177 | NPI----DFLE---AKGYKE--V-RKDLIIK--LPKYSLFE--LENGRKRMLAS | -GELQKGNELALPSKYVNFLYLA | | 1239 |
| BAQ51233 | 1088 | DPI----DFLE---AKGYKE--V-RKDLIIK--LPKYSLFE--LENGRKRMLAS | -GELQKGNELALPSKYVNFLYLA | | 1150 |
| KGE60162 | 352 | DPI----DFLE---AKGYKE--V-RKDLIIK--LPKYSLFE--LENGRKRMLAS | -GELQKGNELALPSKYVNFLYLA | | 414 |
| KGE60856 | 115 | NPI----DFLE---AKGYKE--V-RKDLIIK--LPKYSLFE--LENGRKRMLAS | -GELQKGNELALPSKYVNFLYLA | | 177 |
| WP_002989955 | 1177 | NPI----DFLE---QRGYRN--V-RLEKIIK--LPKYSLFE--LENIKRRLLAS | ARELQKGNELVIPQRFTTLLYHS | | 1239 |
| WP_003030002 | 1159 | HPV----DFLE---NKGYHN--I-REDKLIK--LPKYSLFE--FEGGKRRLLAS | ASELQKGNEMVIPGHLVKLLYHA | | 1221 |
| WP_003065552 | 1187 | NPV----EFLE---SKGYLN--I-RTDKLII--LPKYSLFE--LENGRRRLLAS | AGELQKGNELALPTQFMKFLYLA | | 1249 |
| WP_001040076 | 1186 | NPS----AFLE---SKGYLN--I-RDDKLMI--LPKYSLFE--LENGRRRLLAS | AGELQKGNELALPTQFMKFLYLA | | 1248 |
| WP_001040078 | 1178 | NPS----AFLE---SKGYLN--I-RADKLII--LPKYSLFE--LENGRRRLLAS | AGELQKGNELALPTQFMKFLYLA | | 1240 |
| WP_001040080 | 1178 | NPS----AFLE---SKGYLN--I-RADKLII--LPKYSLFE--LENGRRRLLAS | AGETIDRLQKGNELALPTQFMKFLYLA | | 1240 |
| WP_001040081 | 1178 | NPS----AFLE---SKGYLN--I-RDDKLII--LPKYSLFE--LENGRRRLLAS | AGELQKGNELALPTQFMKFLYLA | | 1240 |
| WP_001040083 | 1178 | NPS----AFLE---SKGYLN--I-RADKLII--LPKYSLFE--LENGRRRLLAS | AGELQKGNELALPTQFMKFLYLA | | 1240 |
| WP_001040085 | 1178 | NPS----AFLE---SKGYLN--I-RADKLII--LPKYSLFE--LENGRRRLLAS | AGELQKGNELALPTQFMKFLYLA | | 1240 |
| WP_001040087 | 1178 | NPS----AFLE---SKGYLN--I-RADKLII--LPKYSLFE--LENGRRRLLAS | AGELQKGNELALPTQFMKFLYLA | | 1240 |
| WP_001040088 | 1178 | NPS----AFLE---SKGYLN--I-RADKLII--LPKYSLFE--LENGRRRLLAS | AGELQKGNELALPTQFMKFLYLA | | 1240 |
| WP_001040089 | 1178 | NPS----AFLE---SKGYLN--I-RDDKLMI--LPKYSLFE--LENGRRRLLAS | AGELQKGNELALPTQFMKFLYLA | | 1240 |
| WP_001040090 | 1178 | NPS----AFLE---SKGYLN--I-RDDKLMI--LPKYSLFE--LENGRRRLLAS | AGELQKGNELALPTQFMKFLYLA | | 1240 |
| WP_001040091 | 1178 | NPS----AFLE---SKGYLN--I-RDDKLMI--LPKYSLFE--LENGRRRLLAS | AGELQKGNELALPTQFMKFLYLA | | 1240 |
| WP_001040092 | 1178 | NPS----AFLE---SKGYLN--I-RTDKLII--LPKYSLFE--LENGRRRLLAS | AGELQKGNELALPTQYMKFLYLA | | 1240 |
| WP_001040094 | 1178 | NPS----AFLE---SKGYLN--I-RTDKLII--LPKYSLFE--LENGRRRLLAS | AGELQKGNELALPTQFMKFLYLA | | 1240 |
| WP_001040095 | 1178 | NPS----AFLE---SKGYLN--I-RDDKLII--LPKYSLFE--LENGRRRLLAS | AGELQKGNELALPTQFMKFLYLA | | 1240 |
| WP_001040096 | 1178 | NPS----AFLE---SKGYLN--I-RDDKLMI--LPKYSLFE--LENGRRRLLAS | AGELQKGNELALPTQFMKFLYLA | | 1240 |
| WP_001040097 | 1178 | NPS----AFLE---SKGYLN--I-RDDKLMI--LPKYSLFE--LENGRRRLLAS | AGELQKGNELALPTQYMKFLYLA | | 1240 |
| WP_001040098 | 1178 | NPS----AFLE---SKGYLN--I-RDDKLMI--LPKYSLFE--LENGRRRLLAS | ADELQKGNELALPTQFMKFLYLA | | 1240 |
| WP_001040099 | 1178 | NPS----AFLE---SKGYLD--I-RDDKLMI--LPKYSLFE--LENGRRRLLAS | AGELQKGNELALPTQFMKFLYLA | | 1240 |
| WP_001040100 | 1178 | NPS----AFLE---SKGYLN--I-RDDKLMI--LPKYSLFE--LENGRRRLLAS | AGELQKGNELALPTQFMKFLYLA | | 1240 |
| WP_001040104 | 1178 | NPS----AFLE---SKGYLN--I-RDDKLMI--LPKYSLFE--LENGRRRLLAS | AGELQKGNELALPTQFMKFLYLA | | 1240 |
| WP_001040105 | 1178 | NPS----AFLE---SKGYLN--I-RDDKLMI--LPKYSLFE--LENGRRRLLAS | AGELQKGNELALPTQYMKFLYLA | | 1240 |
| WP_001040106 | 1178 | NPS----AFLE---SKGYLN--I-RDDKLMI--LPKYSLFE--LENGRRRLLAS | AGELQKGNELALPTQFMKFLYLA | | 1240 |
| WP_001040107 | 1178 | NPS----AFLE---SKGYLN--I-RDDKLMI--LPKYSLFE--LENGRRRLLAS | AGELQKGNELALPTQYMKFLYLA | | 1240 |

| | | | | | | |
|---|---|---|---|---|---|---|
| WP_001040108 | 1178 | NPS---AFLE---SKGYLN---I-RDDKLMI--LPKYSLFE---LENGRRRLLAS | AGELQKGNELALPTQYMKFLYLA | 1240 |
| WP_001040109 | 1178 | NPS---AFLE---SKGYLN---I-RDDKLMI--LPKYSLFE---LENGRRRLLAS | AGELQKGNELALPTQYMKFLYLA | 1240 |
| WP_001040110 | 1178 | NPS---AFLE---SKGYLN---I-RDDKLMI--LPKYSLFE---LENGRRRLLAS | AGELQKGNELALPTQYMKFLYLA | 1240 |
| WP_015058523 | 1178 | NPS---AFLE---SKGYLN---I-RTDKLJI--LPKYSLFE---LENGRRRLLAS | AGELQKGNELALPTQYMKFLYLA | 1240 |
| WP_017643650 | 1178 | NPS---AFLE---SKGYLN---I-RDDKLMI--LPKYSLFE---LENGRRRLLAS | ADELQKGNELALPTQFMKFLYLA | 1240 |
| WP_017647151 | 1178 | NPS---AFLE---SKGYLN---I-RDDKLMI--LPKYSLFE---LENGRRRLLAS | AGELQKGNELALPTQFMKFLYLA | 1240 |
| WP_017648376 | 1178 | NPS---AFLE---SKGYLN---I-RDDKLMI--LPKYSLFE---LENGRRRLLAS | AGELQKGNELALPTQFMKFLYLA | 1240 |
| WP_017649527 | 1178 | NPS---AFLE---SKGYLN---I-RADKLII--LPKYSLFE---LENGRRRLLAS | AGELQKGNELALPTQFMKFLYLA | 1240 |
| WP_017771611 | 1178 | NPS---AFLE---SKGYLN---I-RDDKLMI--LPKYSLFE---LENGRRRLLAS | AGELQKGNELALPTQYMKFLYLA | 1240 |
| WP_017771984 | 1178 | NPS---AFLE---SKGYLN---I-RADKLII--LPKYSLFE---LENGRRRLLAS | AGELQKGNELALPTQFMKFLYLA | 1240 |
| CFQ25032 | 1178 | NPS---AFLE---SKGYLN---I-RADKLJI--LPKYSLFE---LENGRRRLLAS | AGELQKGNELALPTQFMKFLYLA | 1240 |
| CFV16040 | 1178 | NPS---AFLE---SKGYLN---I-RADKLII--LPKYSLFE---LENGRRRLLAS | AGELQKGNELALPTQYMKFLYLA | 1240 |
| KLJ37842 | 1178 | NPS---AFLE---SKGYLN---I-RADKLII--LPKYSLFE---LENGRRRLLAS | AGELQKGNELALPTQFMKFLYLA | 1240 |
| KLJ72361 | 1192 | NPS---AFLE---SKGYLN---I-RDDKLMI--LPKYSLFE---LENGRRRLLAS | AGELQKGNELALPTQYMKFLYLA | 1254 |
| KLL20707 | 1178 | NPS---AFLE---SKGYLN---I-RDDKLJI--LPKYSLFE---LENGRRRLLAS | AGELQKGNELALPTQYMKFLYLA | 1240 |
| KLL42645 | 1178 | NPS---AFLE---SKGYLN---I-RDDKLMI--LPKYSLFE---LENGRRRLLAS | AGELQKGNELALPTQFMKFLYLA | 1240 |
| WP_047207273 | 1178 | NPS---AFLE---SKGYLN---I-RADKLJI--LPKYSLFE---LENGRRRLLAS | AGELQKGNELALPTQFMKFLYLA | 1240 |
| WP_047209694 | 1178 | NPS---AFLE---SKGYLN---I-RDDKLMI--LPKYSLFE---LENGRRRLLAS | AGELQKGNELALPTQFMKFLYLA | 1240 |
| WP_050198062 | 1178 | NPS---AFLE---SKGYLN---I-RADKLJI--LPKYSLFE---LENGRRRLLAS | AGELQKGNELALPTQFMKFLYLA | 1240 |
| WP_050201642 | 1178 | NPS---AFLE---SKGYLN---I-RADKLJI--LPKYSLFE---LENGRRRLLAS | AGELQKGNELALPTQFMKFLYLA | 1240 |
| WP_050204027 | 1178 | NPS---AFLE---SKGYLN---I-RDDKLMI--LPKYSLFE---LENGRRRLLAS | AGELQKGNELALPTQYMKFLYLA | 1240 |
| WP_050881965 | 1178 | NLS---AFLE---SKGYLN---I-RADKLII--LPKYSLFE---LENGRRRLLAS | AGELQKGNELALPTQFMKFLYLA | 1240 |
| WP_050886065 | 1178 | NPS---AFLE---SKGYLN---I-RTDKLJI--LPKYSLFE---LENGRRRLLAS | AGELQKGNELALPTQYMKFLYLA | 1240 |
| AHN30376 | 1178 | NPS---AFLE---SKGYLN---I-RTDKLII--LPKYSLFE---LENGRRRLLAS | AGELQKGNELALPTQYMKFLYLA | 1240 |
| EA078426 | 1178 | NPS---AFLE---SKGYLN---I-RADKLII--LPKYSLFE---LENGRRRLLAS | AGELQKGNELALPTQYMKFLYLA | 1240 |
| CCW42055 | 1186 | DKR---AFIL---GKGYKD---I-K--KIIE--LKDGSRRMLAS | RGEIHKGNELFVPQKFTTLLYHS | 1253 |
| WP_003041502 | 1160 | DFLE---QRGYRN---V-RLEKIIK--LPKYSLFE---LENKRRRLLAS | ARELQKGNELVIPQRFTTLLYHS | 1222 |
| WP_037593752 | 1160 | HPV---DFLE---QRGYRN---V-RLEKIIK--LPKYSLFE---LENKRRRLLAS | ARELQKGNELVIPQRFTTLLYHS | 1222 |
| WP_049516684 | 1159 | NPV---DFLE---QRGYRN---V-RLEKIIK--LPKYSLFE---LENKRRRLLAS | ARELQKGNELVIPQRFTTLLYHS | 1221 |
| GAD46167 | 1191 | NPV---EFIK---NKGYQN---V-QEDKLMK--LPKYSLFE---LENKRRRLLAS | ATELQKGNEIMLSAHLVALLYHA | 1253 |
| WP_018363470 | 1186 | DPI---GFLE---AKGYKD---I-KKELIFK--LPKYSLFE---LENGRRRMLAS | --ELQKANELVLPQHLVRLLYYT | 1248 |
| WP_003043819 | 1159 | DPV---DFLE---QRGYRN---V-RLEKIIK--LPKYSLFE---LENKRRRLLAS | AKELQKGNELVIPQRFTTLLYHS | 1221 |
| WP_006269658 | 1179 | NPI---MFLE---SKGYRN---I-QKDKLIK--LPKYSLFE---FEGGRRRLLAS | AVELQKGNEMVLPQYLNNLLYHA | 1241 |
| WP_048800889 | 1178 | NPL---KPIE---DKGYGN---V-QIDKCIK--LPKYSLFE---FENGTRRMLAS | RGDLQKANEMFLPAKLVTLLY-- | 1245 |
| WP_012767106 | 1178 | NPL---KFIE---DKGYGN---V-QIDKCIK--LPKYSLFE---FENGTRRMLAS | RGDLQKANEMFLPAKLVTLLY-- | 1245 |
| WP_014612333 | 1178 | NPL---KFIE---DKGYGN---V-QIDKCIK--LPKYSLFE---FENGTRRMLAS | RGDLQKANEMFLPAKLVTLLY-- | 1245 |
| WP_015017095 | 1178 | NPL---KPIE---DKGYGN---V-QIDKCIK--LPKYSLFE---FENGTRRMLAS | RGDLQKANEMFLPAKLVTLLY-- | 1245 |
| WP_015057649 | 1178 | NPL---KFIE---DKGYGN---V-QIDKCIK--LPKYSLFE---FENGTRRMLAS | RGDLQKANEMFLPAKLVTLLY-- | 1245 |
| WP_048327215 | 1178 | NPV---VFLE---ARGYRE---I-QEHLIIK--LPKYSLFE---LENGRRRLLAS | -SELQKGNELFLPVDYMTFLYLA | 1219 |
| WP_049519324 | 1157 | NPV---VFLE---ARGYRE---I-QEHLLIK--LPKYSLFE---LENGRRRLLAS | -SELQKGNELFLPVDYMTFLYLA | 1219 |
| WP_012515931 | 1157 | NPV---VFLE---AKGYRE---I-QEHLIIK--LPKYSLFE---LENGRRRLLAS | -SELQKGNELFLPVDYMTFLYLA | 1219 |
| WP_021320964 | 1189 | NPV---VFLE---AKGYHN---V-QEHLIIK--LPKYSLFE---LENGRRRLLAS | -SELQKGNELFLPVDYMTFLYLA | 1251 |
| WP_037581760 | 1184 | NPV---SFLE---KKGYHN---V-REDKLIK--LPKYSLFE---LENGRRRLLAS | ATELQKGNEVVLPQYMVNLLYHS | 1246 |
| WP_044232481 | 1185 | NPV---VFLE---EFLE---NKGYHN---V-QEDKLIK--LPKYSLFE---FEGGRRRLLAS | ASELQKGNEMVLPGYLVELLYHA | 1247 |
| WP_009854540 | 1186 | NPV---EFLE---NKGYHN---V-REDKLIK--LPKYSLFE---LENGRRRLLAS | ASELQKGNEMVLPGYLVELLYHA | 1248 |
| WP_012962174 | 1189 | NPV---SFLE---KKGYHN---V-QEDKLIK--LPKYSLFE---FEGGRRRLLAS | ASELQKGNEMVLPGYLVELLYHA | 1251 |
| WP_039695303 | 1177 | DPI---AFLE---KKGYQD---I-QTSSIIK--LPKYSLFE---LENGRKRLLAS | --ELQKGNELALPNKYVKFLYLA | 1239 |
| WP_014334983 | 1177 | DPI---AFLE---KKGYQD---I-QTSSIIK--LPKYSLFE---LENGRKRLLAS | -KELQKGNELALPNKYVKFLYLA | 1239 |
| WP_003099269 | 1177 | DPI---AFLE---KKGYQD---I-QTSSIIK--LPKYSLFE---LENGRKRLLAS | --ELQKGNELALPNKYVKFLYLA | 1239 |
| AHY15608 | 1177 | DPI---AFLE---KKGYQD---I-QTSSIIK--LPKYSLFE---LENGRKRLLAS | -ELQKGNELALPNKYVKFLYLA | 1239 |
| AHY17476 | 9 | DPI---AFLE---KKGYQD---I-QTSSIIK--LPKYSLFE---LENGRKRLLAS | -KELQKGNELALPNKYVKFLYLA | 71 |
| ESR09100 | 1177 | DPI---AFLE---KKGYQD---I-QTSSIIK--LPKYSLFE---LENGRKRLLAS | -ELQKGNELALPNKYVKFLYLA | 1239 |
| AGM98575 | | | | |

-continued

```
ALF27331        1159 NPV---AFLE---RKGYRN--V-QEENIVK--LPKYSLFE---LENGRRRLLAS ARELQKGNEIVLPNHLGTMLYHA 1221
WP_018372492    1168 EPEr---FlA---QKGFER--V-EKT--IK--LPKYSLFE---MEKGRRRLLAS SGELQKGNQVLLPEHLIRLLSYA 1228
WP_045618028    1189 NPI---AYLE---ECGYKN--I-NPNLIIK--LPKYSLFE---FNNGQRRLLAS SIELQKGNELIVPYHFTALLYHA 1251
WP_045635197    1184 NPI---TFIE---NKGYHN--V-RKENILC--LPKYSLFE---LENGRRRLLAS AKELQKGNELIVPYLTTLLYHS 1246
WP_002263549    1159 DPV---AFLE---RKGYRN--V-QEENIIK--LPKYSLFK---LENGRKRLLAS ARELQKGNEIVLPNHLGTLLYHA 1221
WP_002263887    1159 DPV---AFLE---RKGYRN--V-QEENIIK--LPKYSLFK---LENGRKRLLAS ARELQKGNEIVLPNHLGTLLYHA 1221
WP_002264920    1159 DPV---AFLE---RKGYRN--V-QEENIIK--LPKYSLFK---LENGRKRLLAS ARELQKGNEIVLPNHLGTLLYHA 1221
WP_002269043    1159 DPV---AFLE---RKGYRN--V-QEENIIK--LPKYSLFK---LENGRKRLLAS ARELQKGNEIVLPNHLGTLLYHA 1221
WP_002269448    1159 DPV---AFLE---RKGYRN--V-QEENIIK--LPKYSLFK---LENGRKRLLAS ARELQKGNEIVLPNHLGTLLYHA 1221
WP_002271977    1159 DPV---AFLE---RKGYRN--V-QEENIIK--LPKYSLFK---LENGRKRLLAS ARELQKGNEIVLPNHLGTLLYHA 1221
WP_002272766    1159 DPV---AFLE---RKGYRN--V-QEENIIK--LPKYSLFK---LENGRKRLLAS ARELQKGNEIVLPNHLGTLLYHA 1221
WP_002273241    1159 DPV---AFLE---RKGYRN--V-QEENIIK--LPKYSLFK---LENGRKRLLAS ARELQKGNEIVLPNHLGTLLYHA 1221
WP_002275430    1159 DPV---AFLE---RKGYRN--V-QEENIIK--LPKYSLFK---LENGRKRLLAS ARELQKGNEIVLPNHLGTLLYHA 1221
WP_002276448    1159 DPV---AFLE---RKGYRN--V-QEENIIK--LPKYSLFK---LENGRKRLLAS ARELQKGNEIVLPNHLGTLLYHA 1221
WP_002277050    1167 NPV---KFLK---DKGYQQ--I-EKNNFVK--LPKYTLVD---IGNGIKRLWAS SKEVHKGNQLVVSKKSQDLLYHA 1229
WP_002277364    1159 DPV---AFLE---RKGYRN--V-QEENIIK--LPKYSLFK---LENGRKRLLAS ARELQKGNEIVLPNHLGTLLYHA 1221
WP_002279025    1159 DPV---AFLE---RKGYRN--V-QEENIIK--LPKYSLFK---LENGRKRLLAS ARELQKGNEIVLPNHLGTLLYHA 1221
WP_002279859    1159 DPV---AFLE---RKGYRN--V-QEENIIK--LPKYSLFK---LENGRKRLLAS ARELQKGNEIVLPNHLGTLLYHA 1221
WP_002280230    1159 DPV---AFLE---RKGYRN--V-QEENIIK--LPKYSLFK---LENGRKRLLAS ARELQKGNEIVLPNHLGTLLYHA 1221
WP_002281696    1159 DPV---AFLE---RKGYRN--V-QEENIIK--LPKYSLFK---LENGRKRLLAS ARELQKGNEIVLPNHLGTLLYHA 1221
WP_002282247    1167 NPV---KFIK---DKGYQQ--I-EKNNFVK--LPKYTLVD---IGNGIKRLWAS SKEVHKGNQLVVSKKSQDLLYHA 1229
WP_002282906    1159 DPV---AFLE---RKGYRN--V-QEENIIK--LPKYSLFK---LENGRKRLLAS ARELQKGNEIVLPNHLGTLLYHA 1221
WP_002283846    1159 DPV---AFLE---RKGYRN--V-QEENIIK--LPKYSLFK---LENGRKRLLAS ARELQKGNEIVLPNHLGTLLYHA 1221
WP_002287255    1159 DPV---AFLE---RKGYRN--V-QEENIIK--LPKYSLFK---LENGRKRLLAS ARELQKGNEIVLPNHLGTLLYHA 1221
WP_002288990    1159 DPV---AFLE---RKGYRN--V-QEENIIK--LPKYSLFK---LENGRKRLLAS ARELQKGNEIVLPNHLGTLLYHA 1221
WP_002289641    1159 DPV---AFLE---RKGYRN--V-QEENIIK--LPKYSLFK---LENGRKRLLAS ARELQKGNEIVLPNHLGTLLYHA 1221
WP_002290427    1159 DPI---AFLE---RKGYRN--V-QEENIIK--LPKYSLFK---LENGRKRLLAS ARELQKGNEIVLPNHLGTLLYHA 1221
WP_002295753    1159 DPV---AFLE---RKGYRN--V-QEENIIK--LPKYSLFK---LENGRKRLLAS ARELQKGNEIVLPNHLGTLLYHA 1221
WP_002296423    1173 DPV---AFLE---RKGYRN--V-QEENIIK--LPKYSLFK---LENGRKRLLAS ARELQKGNEIVLPNHLETLLYHA 1235
WP_002304487    1159 DPI---AFLE---RKGYRN--V-QEENIIK--LPKYSLFK---LENGRKRLLAS ARELQKGNEIVLPNHLGTLLYHA 1221
WP_002305844    1159 DPV---AFLE---RKGYRN--V-QEENIIK--LPKYSLFK---LENGRKRLLAS ARELQKGNEIVLPNHLGTLLYHA 1221
WP_002307203    1159 DPI---AFLE---RKGYRN--V-QEENIIK--LPKYSLFK---LENGRKRLLAS ARELQKGNEIVLPDHLGTLLYHA 1221
WP_002310390    1159 DPV---AFLE---RKGYRN--V-QEENIIK--LPKYSLFK---LENGRKRLLAS ARELQKGNEIVLPNHLGTLLYHA 1221
WP_002352408    1159 DPV---AFLE---RKGYRN--V-QEENIIK--LPKYSLFK---LENGRKRLLAS ARELQKGNEIVLPNHLGTLLYHA 1221
WP_012997688    1159 DPV---AFLE---RKGYRN--V-QEENIIK--LPKYSLFK---LENGRKRLLAS ARELQKGNEIVLPNHLGTLLYHA 1221
WP_014677909    1167 NPV---KFIK---DKGYQQ--I-EKNNFVK--LPKYTLVD---IGNGIKRLWAS SKEVHKGNQLVVSKKSQDLLYHA 1229
WP_024784288    1159 DPV---AFLE---RKGYRN--V-QEENIIK--LPKYSLFK---LENGRKRLLAS ARELQKGNEIVLPNHLGTLLYHA 1221
WP_024784666    1159 DPV---AFLE---RKGYRN--V-QEENIIK--LPKYSLFK---LENGRKRLLAS ARELQKGNEIVLPNHLGTLLYHA 1221
WP_024784894    1167 NPV---KFIK---DKGYQQ--I-EKNNFVK--LPKYTLVD---IGNGIKRLWAS SKEVHKGNQLVVSKKSQDLLYHA 1229
WP_024786433    1159 DPI---AFLE---RKGYRN--V-QEENIIK--LPKYSLFK---LENGRKRLLAS ARELQKGNEIVLPNHLGTLLYHA 1221
WP_049473442    1167 NPV---KFIK---DKGYQQ--I-EKNNFVK--LPKYTLVD---IGNGIKRLWAS SKEVHKGNQLVVSKKSQDLLYHA 1229
WP_049474547    1159 DPV---AFLE---RKGYRN--V-QEENIIK--LPKYSLFK---LENGRKRLLAS ARELQKGNEIVLPNHLGTLLYHA 1221
EMC03581        1152 SPI---AFLE---NKGYHN--V-RKENILC--LPKYSLFE---LKNGRKRLLAS AKELQKGNEIVLPVHLTTLLYHA 1214
WP_000428612    1187 NPI---TFIE---NKGYHN--V-RKENILC--LPKYSLFE---LENGRRRLLAS AKELQKGNEIVLPYLTTLLYHS 1249
WP_000428613    1185 NPV---AFLE---GKGYQN--V-VEENIIR--LPKYSLFE---LENGRRRMLAS AKELQKGNEMVLPSYLIALLYHA 1247
WP_049523028    1180 NPV---AFLE---GKGYQN--V-VEENIIR--LPKYSLFE---LENGRRRMLAS AKELQKGNEMVLPSYLIALLYHA 1242
```

```
-continued

WP_003107102  1146  DRI---TFLE--KKGYQD--I-QESLIIK--LPKFSLFE--LENGKRLLAS  -ELQKGNELSLPNKYIQFLYLA  1208
WP_054272988  1179  NPI---AFLE--SKGYHD--I-QEHLMIT--LPKYSLFE--LENGRRLLAS  -ELQKGNEMVLPQHLVTFLYRV  1241
WP_049531101  1189  NPT---AYLE--EYGYKN--I-NPNLIIK--LPKYSLFK--FNDGQRLLAS  SIELQKGNELILPYHFTLLYHA  1251
WP_049538452  1189  NPI---AYLE--ECGYKN--I-NPNLIIK--LPKYSLFE--FNGGQRLLAS  SIELQKGNELILPYHFTALLYHT  1251
WP_049549711  1191  NPI---AYLE--ECGYKN--I-NPNLIIK--LPKYSLFE--LENGRRLLAS  SIELQKGNELALSGKYMKFLYLA  1253
WP_007896501  1183  DNI---AFLE--KKGYQD--I-QEKLLIK--LPKYSLFE--LENGRRLLAS  -EFQKGNELALSGKYMKFLYLA  1245
EFR44625      1135  DNI---AFLE--KKGYQD--I-QEKLLIK--LPKYSLFE--LENGRRLLAS  -EFQKGNELALSGKYMKFLYLA  1197
WP_002897477  1184  NPI---TFLE--NKGYHN--V-RKENILC--LPKYSLFE--LENGRRLLAS  AKELQKGNEIVLPVCLTLLYHS  1246
WP_002906454  1190  NPV---TYLE--ECGYKN--I-NSNLIIK--LPKYSLFE--FNDGQRLLAS  SIELQKGNELILPYHLTALLYHS  1252
WP_009729476  1185  NPI---AFLE--NKGYHN--V-CKENILC--LPKYSLFE--LENGRRLLAS  AIELQKGNEMFLPQQFVNLLYHA  1247
CQR24647      1175  NSV---TFLE--EKGYRN--I-RENTLIK--FPKYSLFE--LESGRRRMLAS AKELQKGNEIVLPVYLTLLYHS  1237
WP_000066813  1189  NPI---TFLE--NKGYHN--V-RKENILC--LPKYSLFE--LENGRRLLAS  AKELQKGNEIVLPVYLTLLYHS  1251
WP_009754323  1185  NPI---TFLE--HKGYKN--I-LEKNIIK--LPKYSLFE--LENGRRLLAS  AKELQKGNEMILPPHLVTLLYHS  1247
WP_044674937  1178  NPI---EFLE--HKGYKN--I-LEKNIIK--LPKYSLFE--LENGRRLLAS  AKELQKGNEMILPPHLVTLLYHS  1240
WP_044676715  1180  NPI---EFLE--HKGYKN--I-LEKNIIK--LPKYSLFE--LENGRRLLAS  AKELQKGNEMILPPHLVTLLYHS  1242
WP_044680361  1180  NPI---EFLE--HKGYKN--I-LEKNIIK--LPKYSLFE--LENGRRLLAS  AKELQKGNEMILPPHLVTLLYHS  1242
WP_044681799  1178  NPI---EFLE--HKGYKN--I-LEKNIIK--LPKYSLFE--LENGRRLLAS  AKELQKGNEMILPPHLVTLLYHS  1240
WP_049533112  1186  DKR---AFLL--GKGYKD--I-K--KIIE--LPKYSLFE--LKDGSRRMLAS RGEIHKGNELFVPQKFTTLLYHA  1253
WP_029090905  1118  SETslqAYIA--EQIKSE--VeILN------grILKYQLIS---NNNGNRLYIYAG -SERHNARQLIVSDEAAKVIWLI  1181
WP_006506696  1150  EKI---NYIE--eKEGLSD--VrIIK------Dn-IPVNQMIEm----DGGEYLLTS -EYVNARQLVLNEKQCALIADI  1211
AIT42264      1177  NPI---DFLE--AKGYKE--V-KKDLIIK--LPKYSLFE--LENGKRMLAS  -GELQKGNELALPSKYVNFLYLA  1239
WP_034440723  1150  EYLG--KIGFNK-AsIIN---S--FKNYTLFE--LENGSRRMIVG KGELQKGNQMVLPQNLLEFVYHL  1211
AKQ21048      1177  QTT---DFLE--EAGYNN--P-TV--LHE--LPKYQLFE--LEDGSRRMIAS -GELQKGNELALPSKYVNFLLYHA  1239
WP_004636532  1151  HPT---AYLE--EAGYNN--P-TV--LHE--LPKYQLFE--LEDGSRRMIAS AKEFQKGNQMVLPLELVELLYHA  1211
WP_002364836  1157  NPI---LFLE--EKGFLR--P-RV--LMK--LPKYTLYE--FPEGRRRLLAS AKEAQKGNQMVLPEHLLTLLYHA  1217
WP_016631044  1108  NPI---LFLE--EKGFLR--P-RV--LMK--LPKYTLYE--FPEGRRRLLAS AKEAQKGNQMVLPEHLLTLLYHA  1168
EM575795       893  DPI---GFlS--NKGYSN--V-TKF--IK--LsKYTLYE--LENGRRRLLAS AKEAQKGNQMVLPEHLLTLLYHA   953
WP_002373311  1157  NPI---LFLE--EKGFLR--P-RV--LMK--LPKYTLYE--FPEGRRRLLAS AKEAQKGNQMVLPEHLLTLLYHA  1217
WP_002378009  1157  NPI---LFLE--EKGFLR--P-RV--LMK--LPKYTLYQ--FPEGRRRLLAS AKEAQKGNQMVLPERLLTLLYHA  1217
WP_002407324  1157  NPI---LFLE--EKGFLR--P-RV--LMK--LPKYTLYE--FPEGRRRLLAS AKEAQKGNQMVLPEHLLTLLYHA  1217
WP_002413717  1159  NPI---LFLE--EKGFLR--P-RV--LMK--LPKYTLYE--FPEGRRRLLAS AKEAQKGNQMVLPEHLLTLLYHA  1219
WP_010775580  1157  NPI---LFLE--EKGFLR--P-RV--LMK--LPKYTLYE--FPEGRRRLLAS AKEAQKGNQMVLPEHLLTLLYHA  1217
WP_010818269  1157  NPI---LFLE--EKGFLR--P-RV--LMK--LPKYTLYE--FPEGRRRLLAS AKEAQKGNQMVLPEHLLTLLYHA  1219
WP_010824395  1157  NPI---LFLE--EKGFLR--P-RV--LMK--LPKYTLYE--FPEGRRRLLAS AKEAQKGNQMVLPEHLLTLLYHA  1217
WP_016622645  1159  NPI---LFLE--NKGYEQ--A-EIE--MK--LPKYALFE--LENGRKRMVAS -KEAQKGNQMVLPEHLLTLLYHA  1219
WP_002312694  1160  SPV---LFLK--NKGYEQ--A-EIE--MK--LPKYALFE--LENGRKRMVAS -KEAQKANSFLLPEHLVTLLYHA  1220
WP_033624816  1160  SPV---LFLK--NKGYEQ--A-EIE--MK--LPKYALFE--LENGRKRMVAS -KEAQKANSFLLPERLLTLLYHA  1220
WP_002314015  1160  SPV---LFLK--NKGYEQ--A-EIE--MK--LPKYALFE--LENGRKRMVAS -KEAQKANSFLLPEHLVTLLYHA  1220
WP_033625576  1160  SPV---LFLK--NKGYEQ--A-EIE--MK--LPKYALFE--LENGRKRMVAS -KEAQKANSFLLPEHLLTLLYHA  1220
WP_033789179  1159  SPV---LFLK--NKGYEQ--A-EIE--MK--LPKYALFE--LENGRKRMVAS -KEAQKANSFLLPEHLVTLLYHA  1219
WP_002310644  1160  SPV---LFLK--NKGYEQ--A-EIE--MK--LPKYALFE--LENGRKRMVAS -KEAQKANSFLLPEHLVTLLYHA  1220
WP_002335161  1160  SPV---LFLK--NKGYEQ--A-EIE--MK--LPKYALFE--LENGRKRMVAS -KEAQKANSFLLPEHLVTLLYHA  1220
WP_002345439  1160  SPV---LFLK--NKGYEQ--A-EIE--MK--LPKYALFE--LENGRKRMVAS -KEAQKANSFLLPEHLVTLLYHA  1220
WP_034686970  1150  DPT---TFLK--NKGFPQ--V-TEF--IK--LPKYTLFE--FDNGRRRFLAS -KESQKGNPFILSDQLVTLLYHA  1210
WP_047937432  1160  SPV---LFLK--NKGYEQ--A-EIE--MK--LPKYALFE--LENGRKRMVAS -KEAQKANSFLLPEHLVTLLYHA  1220
WP_010720994  1150  DPT---TFLK--DKGFPQ--V-TEF--IK--LPKYTLFE--FDNGRRRFLAS -KESQKGNPFILSDQLVTLLYHA  1210
WP_010737004  1150  DPT---TFLK--DKGFPQ--V-TEF--IK--LPKYTLFE--FDNGRRRFLAS -KESQKGNPFILSDQLVTLLYHA  1210
WP_034700478  1150  DPT---TFLK--DKGFPH--V-TEF--IK--LPKYTLFE--FDNGRRRFLAS -KESQKGNPFILSDQLVTLLYHA  1210
WP_007209003  1148  NPI1--YlS---KKDVHN--pkVEAI----LPKYSLFE--FENGRRRMVAS -SETQKGNQLIIPGHLMELLYHS  1208
WP_023519017  1144  DPR---EFLK--TKGYBG--V-KQW--LI--LPKYILFE--AQGGYRRMIAS -QETQKANSLIILPENLVTLLYHA  1204
WP_010770040  1155  DPV---SLLE--EKGYAN--P-EV--LIH--LPKYTLYE--LENGRRLLAS  ANEAQKGNQLVLPASLVTLLYHA  1215
```

-continued

```
WP_048604708  1152  NER----EFLK---NKGYQN--P-QI--CMK--LPKYSLYE---LPKYTLFE--FDDGRRRLLAS  AKEAQKGNQMVLPAHLVTFLYHA     1212
WP_010750235  1153  DPI----SFLI---EKGYSN--V-NQF--IK---LPKYTLFE------LANGQRRMLAS      -QELQKANSFILPEKLVTLLYHA     1213
AII16583      1216  NPI----DFLE---AKGYKE--V-KKDLIIK---LPKYSLFE------LENGRKRMLAS      -GELQKGNELALPSKYVNFLYLA     1278
WP_029073316  1165  TKI----NYIK--eSEGLEE--VkIIK-------E---ILKNQLIET-----NGGLFYVTS     -EIVNARQLILDFNCTRIIDGI     1225
WP_031589969  1165  IKI----NYLK--qAEDLEE--VqIGK-------E---ILKNQLIEk-----DGGLYYIVA     -EIINAKQLIINESQTKLVCEI     1225
KDA45870      1139  DPT----AYLA---SRGYTNvtNsFIL-------PKYSLLEq----PEGRRRYLAS        -KEFQKANELILPQHLVELLYWV     1199
WP_039099354  1171  QKI-spQFTKv---KKQKGtiV-KVVEDFEv-IAPHILINqifFDNGQELTLGS           ---HNEQELILDKTAVKLLNGA     1241
AKP02966      1237  KTL-qNMLE----ENVKHKksIqLIK---Nn-VPIGQIIY--------SKKVGLLS          -REIANRQQLILPPEHSALLRIL    1237
WP_010991369  1155  DEK----AFLE---EQGYRQ--P-KV--LAK--LPKYTLYE------CEEGRRRMLAS       ANEAQKGNQQVLPNHLVTLLHHA    1215
WP_033838504  1155  DEK----AFLE---EQGYRQ--P-KV--LAK--LPKYTLYE------CEEGRRRMLAS       ANEAQKGNQQVLPNHLVTLLHHV    1215
EHN60060      1158  NPI----DFLE---AKGYRQ--P-KV--LAK--LPKYTLYE------CEEGRRRMLAS       -GELQKGNELALPSKYVNFLYLA    1218
EFR89594      924   DEK----AFLE---EQGYRQ--P-KV--LAK--LPKYTLYE------CEEGRRRMLAS       ANEAQKGNQQVLPNHLVTLLHHV     984
WP_038409211  1155  DQK----AFLE---EKGYYS--P-KV--LTK--IPKYTLYE------CENGRRRMLGS       ANEAQKGNQMVLPNHLMTLLYHA    1215
EFR95520      774   DQK----AFLE---EKGYYS--P-KV--LTK--LPKYTLYE------CENGRRRMLGS       ANEAQKGNQMVLPNHLVSLLYHA     834
WP_003723650  1155  DEE----AFLE---EKGYRH--P-KV--LTK--LPKYTLYE------CEKGRRRMLAS       ANEAQKGNQLVLSNHLVSLLYHA    1215
WP_003727705  1155  DEE----AFLE---EKGYRQ--P-KV--LIK--LPKYTLYE------CEKGRRRMLSS       ANEAQKGNQLVLSNHLVSLLYHA    1215
WP_003730785  1155  DEE----AFLE---EKGYHQ--P-KV--LTK--LPKYTLYE------CEKGRRRMLAS       ANEAQKGNQLVLSNHLVSLLYHA    1215
WP_003733029  1155  DEE----TFLE---EKGYHQ--P-KV--LIK--VPKYTLYE------CKNGRRRMLGS       ANEAHKGNQMLLPNHLMALLYHA    1215
WP_003739838  1155  DEE----SFLE---KQGYRQ--P-KV--LTK--LPKYTLYE------CENGRRRMLAS       ANEAQKGNQQVLKGQLITLLHHA    1215
WP_014601172  1155  DEE----AFLE---EKGYRH--P-KV--LTK--LPKYTLYE------CEKGRRRMLAS       ANEAQKGNQLVLSNHLVSLLYHA    1215
WP_023548323  1155  DEK----VFLE---GKGYHQ--P-KV--LTK--LPKYALYE------CENGRRRMLGS       ANEVHKGNQMLLPNHLMTLLYHA    1215
WP_031665337  1155  DEK----AFLE---EKGYRH--P-KV--LTK--LPKYTLYE------CEKGRRRMLAS       ANEAQKGNQLVLSNHLVSLLYHA    1215
WP_031669209  1155  DEK----TFLE---EKGYHQ--P-KV--LIK--VPKYALYE------CKNGRRRMLGS       ANEAHKGNQMLLPNHLMALLYHA    1215
WP_033920898  1155  DEK----VFLE---GKGYHQ--P-KV--LTK--LPKYALYE------CENGRRRMLGS       ANEVHKGNQMLLPNHLMTLLYHA    1215
AKI42028      1158  DEE----AFLE---EKGYRH--P-KV--LTK--LPKYTLYE------CEKGRRRMLAS       ANEAQKGNQLVLSNHLVSLLYHA    1218
AKI50529      1158  DEK----VFLE---GKGYHQ--P-KV--LTK--LPKYALYE------CENGRRRMLGS       ANEVHKGNQMLLPNHLMTLLYHA    1218
EFR83390      603   DQK----EFLE---GKGYRH--P-KV--ITK--IPKYTLYE------CENGRRRMLGS       ANEAQKGNQMVLPNHLMTLLYHA     663
WP_046323366  1155  NPI----DFLE---AKGYKE--V-KKDLIIK---LPKYSLFE------LENGRKRMLAS      -GELQKGNELALPSKYVNFLYLA    1215
AKE81011      1193  HRAD----NFNS-TEYLN--YVSEHKKFEKVLsCVEDFANLYVDVE--KNLsKIR-A VAD-SM--DNFSIEE-                   1255
CU082355      1154  EQI----EYVE-kEEKLSD--VkIIK----Nn-IPLNQLIEi-----DGRQYLLTS         -ECVNAMQLVLNEEQCKLIADI     1215
WP_033162887  1155  EQL----SYIAspeHEDLID--VrIVK-------E---ILKNQLIEi-----DGGLYYVTS    -EYVTARQLSLNEQSCKLISEI     1217
AGZ01981      1210  NPI----DFLE---AKGYKE--V-KKDLIIK---LPKYSLFE------LENGRKRMLAS      -GELQKGNELALPSKYVNFLYLA    1272
AKA60242      1177  NPI----DFLE---AKGYKE--V-KKDLIIK---LPKYSLFE------LENGRKRMLAS      -GELQKGNELALPSKYVNFLYLA    1239
AK540380      1177  NPI----DFLE---AKGYKE--V-KKDLIIK---LPKYSLFE------LENGRKRMLAS      -GELQKGNELALPSKYVNFLYLA    1239
4UN5_B        1181  NPI----DFLE---AKGYKE--V-KKDLIIK---LPKYSLFE------LENGRKRMLAS      -GELQKGNELALPSKYVNFLYLA    1243
WP_010922251  1240  SHYEKLKgSPEDnEQKQL--FVEQHKHYLDEIIEQISEFSKRVILAD--ANLDKVL-S AYN-KH---RDKPIREq-                1305
WP_010922251  1249  SHYEKLKgSPEDnEQKQL--FVEQHKHYLDEIIEQISEFSKRVILAD--ANLDKVL-S AYN-KH---RDKPIREq-                1305
WP_039695303  1247  KNVH----KLDE-PGHLE--YIQKHRNEFKDLLNLVSEFSQKVLAD--ANLEKIK-S LYA-DN--EQADIEI-                   1308
WP_045635197  979   GELYRVIgVNNDILNRIE---VNMIDITYREYLENMDKRPPRIIKTiaSKTQSIK-K LYbvKSk--KHPQIIKg                  1306
5AXW_A        924   SHYEKLKgSPEDnEQKQL--FVEQHKHYLDEIIEQISEFSKRVILAD--ANLDKVL-S AYN-KH---RDKPIREq-                1056
WP_009880683  1240  SHYEKLKgSPEDnEQKQL--FVEQHKHYLDEIIEQISEFSKRVILAD--ANLDKVL-S AYN-KH---RDKPIREq-                989
WP_010922251  1240  SHYEKLKgSPEDnEQKQL--FVEQHKHYLDEIIEQISEFSKRVILAD--ANLDKVL-S AYN-KH---RDKPIREq-                1305
WP_011054416  1240  SHYEKLKgSPEDnEQKQL--FVEQHKHYLDEIIEQISEFSKRVILAD--ANLDKVL-S AYN-KH---RDKPIREq-                1305
WP_011284745  1240  SHYEKLKgSPEDnEQKQL--FVEQHKHYLDEIIEQISEFSKRVILAD--ANLDKVL-S AYN-KH---RDKPIREq-                1305
WP_011285506  1240  SHYEKLKgSPEDnEQKQL--FVEQHKHYLDEIIEQISEFSKRVILAD--ANLDKVL-S AYN-KH---RDKPIREq-                1305
WP_011527619  1240  SHYEKLKgSPEDnEQKQL--FVEQHKHYLDEIIEQISEFSKRVILAD--ANLDKVL-S AYN-KH---RDKPIREq-                1305
WP_012560673  1239  SHYEKLKgSPEDnEQKQL--FVEQHKHYLDEIIEQISEFSKRVILAD--ANLDKVL-S AYN-KH---RDKPIREq-                1304
WP_014407541  1239  SHYEKLKgSPEDnEQKQL--FVEQHKHYLDEIIEQISEFSKRVILAD--ANLDKVL-S AYN-KH---RDKPIREq-                1304
WP_020905136  1240  SHYEKLKgSPEDnEQKQL--FVEQHKHYLDEIIEQISEFSKRVILAD--ANLDKVL-S AYN-KH---RDKPIREq-                1305
WP_023080005  1240  SHYEKLKgSPEDnEQKQL--FVEQHKHYLDEIIEQISEFSKRVILAD--ANLDKVL-S AYN-KH---RDKPIREq-                1305
WP_023610282  1239  SHYEKLKgSPEDnEQKQL--FVEQHKHYLDEIIEQISEFSKRVILAD--ANLDKVL-S AYN-KH---RDKPIREq-                1304
WP_030125963  1240  SHYEKLKgSPEDnEQKQL--FVEQHKHYLDEIIEQISEFSKRVILAD--ANLDKVL-S AYN-KH---RDKPIREq-                1305
WP_030126706  1240  SHYEKLKgSPEDnEQKQL--FVEQHKHYLDEIIEQISEFSKRVILAD--ANLDKVL-S AYN-KH---RDKPIREq-                1305
WP_031488318  1240  SHYEKLKgSPEDnEQKQL--FVEQHKHYLDEIIEQISEFSKRVILAD--ANLDKVL-S AYN-KH---RDKPIREq-                1305
```

| | | | |
|---|---|---|---|
| WP_032460140 | 1240 | SHYEKLkgSPEDnEQKQL--FVEQHKHYLDEIIEQISEFSKRVILAD--ANLDKVL-S AYN-KH---RDKPIREq | 1305 |
| WP_032461047 | 1240 | SHYEKLkgSPEDnEQKQL--FVEQHKHYLDEIIEQISEFSKRVILAD--ANLDKVL-S AYN-KH---RDKPIREq | 1305 |
| WP_032462016 | 1240 | SHYEKLkgSPEDnEQKQL--FVEQHKHYLDEIIEQISEFSKRVILAD--ANLDKVL-S AYN-KH---RDKPIREq | 1305 |
| WP_032462936 | 1240 | SHYEKLkgSPEDnEQKQL--FVEQHKHYLDEIIEQISEFSKRVILAD--ANLDKVL-S AYN-KH---RDKPIREq | 1305 |
| WP_032464890 | 1240 | SHYEKLkgSPEDnEQKQL--FVEQHKHYLDEIIEQISEFSKRVILAD--ANLDKVL-S AYN-KH---RDKPIREq | 1305 |
| WP_033888930 | 1065 | SHYEKLkgSPEDnEQKQL--FVEQHKHYLDEIIEQISEFSKRVILAD--ANLDKVL-S AYN-KH---RDKPIREq | 1130 |
| WP_038431314 | 1240 | SHYEKLkgSPEDnEQKQL--FVEQHKHYLDEIIEQISEFSKRVILAD--ANLDKVL-S AYN-KH---RDKPIREq | 1305 |
| WP_038432938 | 1239 | SHYEKLkgSPEDnEQKQL--FVEQHKHYLDEIIEQISEFSKRVILAD--ANLDKVL-S AYN-KH---RDKPIREq | 1304 |
| WP_038434062 | 1240 | SHYEKLkgSPEDnEQKQL--FVEQHKHYLDEIIEQISEFSKRVILAD--ANLDKVL-S AYN-KH---RDKPIREq | 1305 |
| BAQ51233 | 1151 | SHYEKLkgSPEDnEQKQL--FVEQHKHYLDEIIEQISEFSKRVILAD--ANLDKVL-S AYN-KH---RDKPIREq | 1216 |
| KGE60162 | 415 | SHYEKLkgSPEDnEQKQL--FVEQHKHYLDEIIEQISEFSKRVILAD--ANLDKVL-S AYN-KH---RDKPIREq | 480 |
| KGE60856 | 178 | SHYEKLkgSPEDnEQKQL--FVEQHKHYLDEIIEQISEFSKRVILAD--ANLDKVL-S AYN-KH---RDKPIREq | 243 |
| WP_002989955 | 1240 | SHYEKLkgSPEDnEQKQL--FVEQHKHYLDEIIEQISEFSKRVILAD--ANLDKVL-S AYN-KH---RDKPIREq | 1305 |
| WP_003030002 | 1222 | YQIE----KNYE-PEHRE--YVEKHKDEFKELLEYISVFSRKYVLAD--NNLTKIE-M LFS-KN---KDAEVSS- | 1281 |
| WP_003065552 | 1250 | QRIN---SENS-TKYLD--YVSAHKKEFEKVLSCVEDFANLYVDVE--KNLSKIR-A VAD-SM---DNFSIEE- | 1309 |
| WP_001040076 | 1241 | SRYNESKgKPEEiEKKQE--FVNQHVSYFDDILQLINDFSKRVILAD--ANLEKIN-R LYQ-DNK---ENIPVDE- | 1314 |
| WP_001040078 | 1241 | SRYNESKgKPEEiEKKQE--FVNQHVSYFDDILQLINDFSKRVILAD--ANLEKIN-K LYQ-DNK---ENISVDE- | 1306 |
| WP_001040080 | 1241 | SRYNESKgKPEEiEKKQE--FVNQHVSYFDDILQLINDFSKRVILAD--ANLEKIN-K LYQ-DNK---ENISVDE- | 1306 |
| WP_001040081 | 1241 | SRYNESKgKPEEiEKKQE--FVNQHVSYFDDILQLINDFSKRVILAD--ANLEKIN-K LYQ-DNK---ENISVDE- | 1306 |
| WP_001040083 | 1241 | SRYNESKgKPEEiEKKQE--FVNQHVSYFDDILQLINDFSKRVILAD--ANLEKIN-K LYQ-DNK---ENISVDE- | 1306 |
| WP_001040085 | 1241 | SRYNESKgKPEEiEKKQE--FVNQHVSYFDDILQLINDFSKRVILAD--ANLEKIN-K LYQ-DNK---ENISVDE- | 1306 |
| WP_001040087 | 1241 | SRYNESKgKPEEiEKKQE--FVNQHVSYFDDILQLINDFSKRVILAD--ANLEKIN-K LYQ-DNK---ENIPVDE- | 1306 |
| WP_001040088 | 1241 | SRYNESKgKPEEiEKKQE--FVNQHVSYFDDILQLINDFSKRVILAD--ANLEKIN-K LYQ-DNK---ENIPVDE- | 1306 |
| WP_001040089 | 1241 | SRYNESKgKPEEiEKKQE--FVNQHVSYFDDILQLINDFSKRVILAD--ANLEKIN-K LYQ-DNK---ENIPVDE- | 1306 |
| WP_001040090 | 1241 | SRYNESKgKPEEiEKKQE--FVNQHVSYFDDILQLINDFSKRVILAD--ANLEKIN-K LYQ-DNK---ENIPVDE- | 1306 |
| WP_001040091 | 1241 | SRYNESKgKPEEiEKKQE--FVNQHVSYFDDILQLINDFSKRVILAD--ANLEKIN-K LYQ-DNK---ENIPVDE- | 1306 |
| WP_001040092 | 1241 | SRYNESKgKPEEiEKKQE--FVNQHISYFDDILQLINDFSKRVILAD--ANLEKIN-K LYS-DNK---DNTPVDE- | 1306 |
| WP_001040094 | 1241 | SRYNELKgKPEEiEKKQE--FVNQHVSYFDDILQLINDFSNRVILAD--ANLEKIN-K LYQ-DNK---ENIPVDE- | 1306 |
| WP_001040095 | 1241 | SRYNELKgKPEEiEKKQE--FVVQHVSYFDDILQLINDFSNRVILAD--ANLEKIN-K LYQ-DNK---ENIPVDE- | 1306 |
| WP_001040096 | 1241 | SRYNELKgKPEEiEQKQE--FVVQHVSYFDDILQLINDFSNRVILAD--ANLEKIN-K LYQ-DNK---ENIPVDE- | 1306 |
| WP_001040097 | 1241 | SRYNELKgKPEEiEQKQE--FVVQHVSYFDDILQLINDFSNRVILAD--ANLEKIN-K LYQ-DNK---ENIPVDE- | 1306 |
| WP_001040098 | 1241 | SRYNELKgKPEEiEQKQE--FVVQHVSYFDDILQLINDFSNRVILAD--ANLEKIN-K LYQ-DNK---ENIPVDE- | 1306 |
| WP_001040099 | 1241 | SRYNELKgKPEEiEQKQE--FVVQHVSYFDDILQLINDFSNRVILAD--ANLEKIN-K LYQ-DNK---ENISVDE- | 1306 |
| WP_001040100 | 1241 | SRYNELKgKPEEiEQKQE--FVVQHVSYFDDILQLINDFSNRVILAD--ANLEKIN-K LYQ-DNK---ENISVDE- | 1306 |
| WP_001040104 | 1241 | SRYNESKgKPEEiEKKQE--FVNQHVSYFDDILQLINDFSKRVILAD--ANLEKIN-K LYQ-DNK---ENISVDE- | 1306 |
| WP_001040105 | 1241 | SRYNESKgKPEEiEKKQE--FVNQHVSYFDDILQLINDFSKRVILAD--ANLEKIN-K LYQ-DNK---ENISVDE- | 1306 |
| WP_001040106 | 1241 | SRYNESKgKPEEiEKKQE--FVNQHVSYFDDILQLINDFSKRVILAD--ANLEKIN-K LYQ-DNK---ENISVDE- | 1306 |
| WP_001040107 | 1241 | SRYNESKgKPEEiEKKQE--FVNQHVSYFDDILQLINDFSKRVILAD--ANLEKIN-K LYQ-DNK---ENISVDE- | 1306 |
| WP_001040108 | 1241 | SRYNESKgKPEEiEKKQE--FVNQHVSYFDDILQLINDFSKRVILAD--ANLEKIN-K LYQ-DNK---ENISVDE- | 1306 |
| WP_001040109 | 1241 | SRYNESKgKPEEiEKKQE--FVNQHVSYFDDILQLINDFSKRVILAD--ANLEKIN-K LYQ-DNK---ENISVDE- | 1306 |
| WP_001040110 | 1241 | SRYNESKgKPEEiEKKQE--FVNQHVSYFDDILQLINDFSKRVILAD--ANLEKIN-K LYQ-DNK---ENISVDE- | 1306 |
| WP_015058523 | 1241 | SRYNESKgKPEEiEKKQE--FVNQHVSYFDDILQLINDFSKRVILAD--ANLEKIN-K LYS-DNK---DNTPVDE- | 1306 |
| WP_017643650 | 1241 | SRYNESKgKPEEiEKKQE--FVNQHVSYFDDILQLINDFSKRVILAD--ANLEKIN-K LYQ-DNK---ENIPVDE- | 1306 |
| WP_017647151 | 1241 | SRYNESKgKPEEiEKKQE--FVNQHVSYFDDILQLINDFSKRVILAD--ANLEKIN-K LYQ-DNK---ENISVDE- | 1306 |
| WP_017648376 | 1241 | SRYNESKgKPEEiEKKQE--FVNQHVSYFDDILQLINDFSKRVILAD--ANLEKIN-K LYQ-DNK---ENISVDE- | 1306 |
| WP_017649527 | 1241 | SRYNESKgKPEEiEKKQE--FVNQHVSYFDDILQLINDFSKRVILAD--ANLEKIN-K LYQ-DNK---ENISVDE- | 1306 |
| WP_017771611 | 1241 | SRYNESKgKPEEiEKKQE--FVNQHVSYFDDILQLINDFSKRVILAD--ANLEKIN-K LYQ-DNK---ENISVDE- | 1306 |
| WP_017771984 | 1241 | SRYNESKgKPEEiEKKQE--FVNQHVSYFDDILQLINDFSKRVILAD--ANLEKIN-K LYQ-DNK---ENISVDE- | 1306 |
| CFQ25032 | 1241 | SRYNESKgKPEEiEKKQE--FVNQHVSYFDDILQLINDFSKRVILAD--ANLEKIN-K LYQ-DNK---ENISVDE- | 1306 |
| CFV16040 | 1241 | SRYNESKgKPEEiEKKQE--FVNQHVSYFDDILQLINDFSKRVILAD--ANLEKIN-K LYQ-DNK---ENISVDE- | 1306 |
| KLJ37842 | 1241 | SRYNESKgKPEEiEKKQE--FVNQHVSYFDDILQLINDFSKRVILAD--ANLEKIN-K LYQ-DNK---ENISVDE- | 1306 |
| KLJ72361 | 1241 | SRYNESKgKPEEiEKKQE--FVNQHVSYFDDILQLINDFSKRVILAD--ANLEKIN-K LYQ-DNK---ENISVDE- | 1306 |
| KLL20707 | 1255 | SRYNESKgKPEEiEKKQE--FVNQHVSYFDDILQLINDFSKRVILAD--ANLEKIN-K LYQ-DNK---ENISVDE- | 1320 |

```
KLL42645           1241 SRYNELkgKPEEiEQKQE--FVVQHVSYFDDILQIINDFSNRVILAD--ANLEKIN-K LYQ-DNk--ENISVDE-   1306
WP_047207273       1241 SRYNESKgKPEEiEKKQE--FVNQHVSYFDDILQIINDFSKRVILAD--ANLEKIN-K LYQ-DNk--ENISVDE-   1306
WP_047209694       1241 SRYNELKgKPEEiEQKQE--FVNQHVSYFDDILQIINDFSNRVILAD--ANLEKIN-K LYQ-DNk--ENIPVDE-   1306
WP_050198062       1241 SRYNESKgKPEEiEKKQE--FVNQHVSYFDDILQIINDFSKRVILAD--ANLEKIN-K LYQ-DNk--ENISVDE-   1306
WP_050201642       1241 SRYNESKgKPEEiEKKQE--FVNQHVSYFDDILQIINDFSKRVILAD--ANLEKIN-K LYQ-DNk--ENISVDE-   1306
WP_050204027       1241 SRYNESKgKPEEiEKKQE--FVVQHVSYFDDILQIINDFSNRVILAD--ANLEKIN-K LYQ-DNk--ENISVDE-   1306
WP_050881965       1241 SRYNESKgKPEEiEKKQE--FVNQHVSYFDDILQIINDFSKRVILAD--ANLEKIN-K LYQ-DNk--ENISVDE-   1306
WP_050886065       1241 SRYNESKgKPEEiEKKQE--FVNQHVSYFDDILQIINDFSKRVILAD--ANLEKIN-K LYQ-DNk--ENISVDE-   1306
AHN30376           1241 SRYNESKgKPEEiEKKQE--FVNQHVSYFDDILQIINDFSKRVILAD--ANLEKIN-K LYS-DNk--DNTPVDE-   1306
EA078426           1241 SRYNESKgKPEEiEKKQE--FVNQHVSYFDDILQIINDFSNRVILAD--ANLEKIN-K LYQ-DNk--ENISVDE-   1306
CCW42055           1241 SRYNESKgKPEEiEKKQE--FVNQHVSYFDDILQIINDFSNRVILAD--ANLEKIN-K LYQ-DNk--ENISVDE-   1306
WP_003041502       1254 KRIN---NPIN-KDHIE--YVKKHRDDFKELLNYVLEFNEKVGAT-KNGRLK-E AVA-DF--DSKSNEE-           1313
WP_037593752       1223 YQIE----KNYE-PEHRE--YVEKHKDEFKELLEYISVFSRKVVLAD--NNLTKIE-M LFS-KN--KDAEVSS           1282
WP_049516684       1223 YRIE----KDYE-PEHRE--YVEKHKDEFKELLEYISVFSRKVVLAD--NNLTKIE-M LFS-KN--KDAEVSS           1282
GAD46167           1222 YQIE----KNYE-PEHRE--YVEKHKDEFKELLEYISVFSRKVVLAD--NNLTKIE-M LFS-KN--KDAEVSS           1281
WP_018363470       1254 HRIG----NFNS-AEHLK--YVSEHKKFFEEVLSCVENFANVVDVE--KNLsKIR-A AAD-SM--DNFSIEE-           1313
WP_003043819       1249 QNISATTgSNNLg----------YIEQHREEFKEIFEKIIDFSEKYILKN--KVNSNLK-S SFD-EQfavSDSIl--1     1310
WP_006269658       1242 YRIE----KDYE-PEHRE--YVEKHKDEFKELLEYISVFSRKVVLAD--NNLTKIE-M LFS-KN--KDAEVSS           1281
WP_048800889       1301 HRID----NSDN-SEHLK--YITEHKEEFGKLLSYIERFAKSVDVD--KNLEKIQ-L AVE-KI--DSFSVKE           1301
WP_012767106       1308 -HAHKIEsSKE--LEHEA--YILDHYNDLYQLLSYIERFASLYVDVE--KNISKVK-E LFS-NI--ESYSISEi         1308
WP_014612333       1246 -HAHKIEsSKE--LEHEA--YILDHYNDLYQLLSYIERFASLYVDVE--KNISKVK-E LFS-NI--ESYSISEi         1308
WP_015017095       1246 -HAHKIEsSKE--LEHEA--YILDHYNDLYQLLSYIERFASLYVDVE--KNISKVK-E LFS-NI--ESYSISEi         1308
WP_015057649       1246 -HAHKIEsSKE--LEHEA--YILDHYNDLYQLLSYIERFASLYVDVE--KNISKVK-E LFS-NI--ESYSISEi         1308
WP_048272215       1246 -HAHKIEsSKE--LEHEA--YILDHYNDLYQLLSYIERFASLYVDVE--KNISKVK-E LFS-NI--ESYSISEi         1308
WP_049519324       1246 -HAHKIEsSKE--LEHEA--YILDHYNDLYQLLSYIERFASLYVDVE--KNISKVK-E LFS-NI--ESYSISEi         1308
WP_012515931       1220 AHYHELTgSSEDvLRKKY--FVDRHLHYFDDIIQMINDFAERHILAS--SNLEKIN-H TYH-NN--SDLPINEr         1285
WP_021320964       1220 AHYHELTgSSEDvLRKKY--FVDRHLHYFDDIIQMINDFAERHILAS--SNLEKIN-H TYH-NN--SDLPINEr         1285
WP_037581760       1220 AHYHELTgSSEDvLRKKY--FVERHLHYFDDIIQMINDFAERHILAS--SNLEKIN-H TYH-NN--SDLPVNEr         1285
WP_004232481       1252 QHVN----NSHK-PEHLN--YVKQHKDEFKDIPNLIISIARINILKP--KVVDNL-- -IN EF--TEYGQED           1308
WP_009854540       1247 HRAD----NFNS-TEYLN--YVSEHKKEFEKVLSCVEDFANLYVDVE--KNLSKIR-A VAD-SM--DNFSIED-         1306
WP_012962174       1248 HRVN----SFNN-SEHLK--YVSEHKKEFGEVLSCVENFAKSVDVE--KNLGKIR-A VAD-KI--DTFSIED-          1307
WP_039695303       1249 HRAD----NENS-TEYLN--YVSEHKKEFEKVLSCVEDFANLYVDVE--KNLSKIR-A VAD-SM--TNFSLEE-         1308
WP_014334983       1252 HRID----SFNS-TEHLK--YVSEHKKEFEKVLSCVENFSNLYVDVE--KNLSKVR-A AAE-SM--TNFSLEE-         1311
WP_003099269       1240 SHYTKFTgKEEDrEKKRS--YVESHLYFFDEIMQIIVEYSNRYILAD--SNLIKIQ-N LYK-EKq--NFSIEEq         1305
AHYI5608           1240 SHYTKFTgKEEDrEKKRS--YVESHLYFXXX-----------------------------                      1273
AHYI7476           1240 SHYTKFTgKEEDrEKKRS--YVESHLYXFX----------------------------                       1267
ESR09100             72 SHYTKFTgKEEDrEKKRS--YVESHLYYFDEIMQIIVEYSNRYILAD--SNLIKIQ-N LYK-Ek--DNFSIEEq-       137
AGM98575           1240 KNIH----KVDE-PKHLD--YVKKHKDEFKELLDVVSNFSKKNILAE--SNLEKIE-E LYA-QN--NNKDITE-        1281
ALF27331           1222 KKVDVLVkSKDD--DYD--LEEHHRAEFAELLDCIKKFNDMYILAS--SNMSKIE-E IYQ-KNi--DAPIEE-         1289
WP_018372492       1229 QRIN----KISE-PIHKQ--YVETHQSEFKELLTAIISLSKKYI-QK--PNVESL-- LQQ-AF--DQSDKDIyq        1310
WP_045618028       1252 KNVH----KLDE-PGHLE--YIQKHRNEFKDLLNLVSEFSQKVLAD--ANLEKIK-S LYA-DN--EQADIEI-         1306
WP_045635197       1247 KNIH----KVDE-PKHLD--YVDKHKDEFKELLDVVSNFSKKYTLAE--GNLEKIK-E LYA-QN--NGEDLKE-        1281
WP_002263549       1222 KNIH----KVDE-PKHLD--YVDKHKDEFKELLDVVSNFSKKYTLAE--GNLEKIK-E LYA-QN--NGEDLKE-        1281
WP_002263887       1222 KNIH----KVDE-PKHLD--YVDKHKDEFKELLDVVSNFSKKYTLAE--GNLEKIK-E LYA-QN--NGEDLKE-        1281
WP_002264920       1222 KNIH----KVDE-PKHLD--YVDKHKDEFKELLDVVSNFSKKYTLAE--GNLEKIK-E LYA-QN--NGEDLKE-        1281
WP_002269043       1222 KNIH----KVDE-PKHLD--YVDKHKDEFKELLDVVSNFSKKYTLAE--GNLEKIK-E LYA-QN--NGEDLKE-        1281
WP_002269448       1222 KNIH----KVDE-PKHLD--YVDKHKDEFKELLDVVSNFSKKYTLAE--GNLEKIK-E LYA-QN--NGEDLKE-        1281
WP_002271977       1222 KNIH----KVDE-PKHLD--YVDKHKDEFKELLDVVSNFSKKYTLAE--GNLEKIK-E LYA-QN--NGEDLKE-        1281
WP_002272766       1222 KNIH----KVDE-PKHLD--YVDKHKDEFKELLDVVSNFSKKYTLAE--GNLEKIK-E LYA-QN--NGEDLKE-        1281
WP_002273241       1222 KNIH----KVDE-PKHLD--YVDKHKDEFKELLDVVSNFSKKYTLAE--GNLEKIK-E LYA-QN--NGEDLKE-        1281
WP_002275430       1222 KNIH----KVDE-PKHLD--YVDKHKDEFKELLDVVSNFSKKYTLAE--GNLEKIK-E LYA-QN--NGEDLKE-        1281
WP_002276448       1222 KNIH----KVDE-PKHLD--YVDKHKDEFKELLDVVSNFSKKYTLAE--GNLEKIK-E LYA-QN--NGEDLKE-        1281
WP_002277050       1230 HHL-----DN-DYSNE--YVKNHYQQFPDILFNEITSFSKKCKLGK--EHIQKIE-E AYSkER--DSASIEE-        1287
```

-continued

```
WP_002273364  1222  KNIH----KVDE-PKHLD--YVDKHKDEFKELLDVVSNFSKKYTLAE--GNLEKIK-E LYA-QN---NGEDLKE  1281
WP_002279025  1222  KNIH----KVDE-PKHLD--YVDKHKDEFKELLDVVSNFSKKYTLAE--GNLEKIK-E LYA-QN---NGEDLKE  1281
WP_002279859  1222  KNIH----KVDE-PKHLD--YVDKHKDEFKELLDVVSNFSKKYTLAE--GNLEKIK-E LYA-QN---NGEDLKE  1281
WP_002280230  1222  KNIH----KVDE-PKHLD--YVDKHKDEFKELLDVVSNFSKKYTLAE--GNLEKIK-E LYA-QN---NGEDLKE  1281
WP_002281696  1222  KNIH----KVDE-PKHLD--YVDKHKDEFKELLDVVSNFSKKYTLAE--GNLEKIK-E LYA-QN---NGEDLKE  1281
WP_002282247  1230  HHL------DN-DYSNE--YVKNHYQQFDILFNEITSFSKKCKLGK--EHIQKIE-E AYSkER---DFASIEE  1287
WP_002282906  1222  KNIH----KVDE-PKHLD--YVDKHKDEFKELLDVVSNFSKKYTLAE--GNLEKIK-E LYA-QN---NGEDLKE  1281
WP_002283846  1222  KNIH----KVDE-PKHLD--YVDKHKDEFKELLDVVSNFSKKYTLAE--GNLEKIK-E LYA-QN---NGEDLKE  1281
WP_002287255  1222  KNIH----KVDE-PKHLD--YVDKHKDEFKELLDVVSNFSKKYTLAE--GNLEKIK-E LYA-QN---NGEDLKE  1281
WP_002288990  1222  KNIH----KVDE-PKHLD--YVDKHKDEFKELLDVVSNFSKKYTLAE--GNLEKIK-E LYA-QN---NGEDLKE  1281
WP_002289641  1222  KNIH----KVDE-PKHLD--YVDKHKDEFKELLDVVSNFSKKYTLAE--GNLEKIK-E LYA-QN---NGEDLKE  1281
WP_002290427  1222  KNIH----KVDE-PKHLD--YVDKHKDEFKELLDVVSNFSKKYTLAE--GNLEKIK-E LYA-QN---NGEDLKE  1281
WP_002295753  1222  KNIH----KVDE-PKHLD--YVDKHKDEFKELLDVVSNFSKKYTLAE--GNLEKIK-E LYA-QN---NGEDLKE  1281
WP_002296423  1222  KNIH----KVDE-PKHLD--YVDKHKDEFKELLDVVSNFSKKYTLAE--GNLEKIK-E LYA-QN---NGEDLKE  1281
WP_002304487  1236  KNIH----KVDE-PKHLD--YVDKHKDEFKELLDVVSNFSKKYTLAE--GNLEKIK-E LYA-QN---NGEDLKE  1295
WP_002305844  1222  KNIH----KVDE-PKHLD--YVDKHKDEFKELLDVVSNFSKKYTLAE--GNLEKIK-E LYA-QN---NGEDLKE  1281
WP_002307203  1222  KNIH----KVDE-PKHLD--YVDKHKDEFKELLDVVSNFSKKYTLAE--GNLEKIK-E LYA-QN---NGEDLKE  1281
WP_002310390  1222  KNIH----KVDE-PKHLD--YVDKHKDEFKELLDVVSNFSKKYTLAE--GNLEKIK-E LYA-QN---NGEDLKE  1281
WP_002352408  1222  KNIH----KVDE-PKHLD--YVDKHKDEFKELLDVVSNFSKKYTLAE--GNLEKIK-E LYA-QN---NGEDLKE  1281
WP_012997688  1222  KNIH----KVDE-PKHLD--YVDKHKDEFKELLDVVSNFSKKYTLAE--GNLEKIK-E LYA-QN---NGEDLKE  1281
WP_014677909  1222  KNIH----KVDE-PKHLD--YVDKHKDEFKELLDVVSNFSKKYTLAE--GNLEKIK-E LYA-QN---NGEDLKE  1281
WP_019312892  1222  KNIH----KVDE-PKHLD--YVDKHKDEFKELLDVVSNFSKKYTLAE--GNLEKIK-E LYA-QN---NGEDLKE  1281
WP_019313659  1222  KNIH----KVDE-PKHLD--YVDKHKDEFKELLDVVSNFSKKYTLAE--GNLEKIK-E LYA-QN---NGEDLKE  1281
WP_019314093  1222  KNIH----KVDE-PKHLD--YVDKHKDEFKELLDVVSNFSKKYTLAE--GNLEKIK-E LYA-QN---NGEDLKE  1281
WP_019315370  1222  KNIH----KVDE-PKHLD--YVDKHKDEFKELLDVVSNFSKKYTLAE--GNLEKIK-E LYA-QN---NGEDLKE  1281
WP_019803776  1222  KNIH----KVDE-PKHLD--YVDKHKDEFKELLDVVSNFSKKYTLAE--GNLEKIK-E LYA-QN---NGEDLKE  1281
WP_019805234  1222  KNIH----KVDE-PKHLD--YVDKHKDEFKELLDVVSNFSKKYTLAE--GNLEKIK-E LYA-QN---NGEDLKE  1281
WP_024783594  1222  KNIH----KVDE-PKHLD--YVDKHKDEFKELLDVVSNFSKKYTLAE--GNLEKIK-E LYA-QN---NGEDLKE  1281
WP_024784288  1230  HHL------DN-DYSNE--YVKNHYQQFDILFNEITSFSKKCKLGK--EHIQKIE-E AYSkER---DFASIEE  1287
WP_024784666  1222  KNIH----KVDE-PKHLD--YVDKHKDEFKELLDVVSNFSKKYTLAE--GNLEKIK-E LYA-QN---NGEDLKE  1281
WP_024784894  1222  KNIH----KVDE-PKHLD--YVDKHKDEFKELLDVVSNFSKKYTLAE--GNLEKIK-E LYA-QN---NGEDLKE  1281
WP_024786433  1230  HHL------DN-DYSNE--YVKNHYQQFDILFNEITSFSKKCKLGK--EHIQKIE-E AYSkER---DSASIEE  1287
WP_049473442  1222  KNIH----KVDE-PKHLD--YVDKHKDEFKELLDVVSNFSKKYTLAE--GNLEKIK-E LYA-QN---NGEDLKE  1281
WP_049474547  1222  KNIH----KVDE-PKHLD--YVDKHKDEFKELLDVVSNFSKKYTLAE--GNLEKIK-E LYA-QN---NGEDLKE  1281
EMC03581      1215  KNIH----RLDE-PEHLE--YIQKHRNEFKGLLNLVSEFSQKKYTLAE--ANLEKIK-N LYA-DN---EQADIEI  1274
WP_000428612  1250  KNIH----RLDE-PEHLE--YIQKHRNEFKGLLNLVSEFSQKKYTLAE--ANLEKIK-N LYA-DN---EQADIEI  1309
WP_000428613  1248  KNVH----KLDE-PEHLE--YIQKHRNEFKDLLNLVSEFSQKYTLAD--ANLEKIQ-N LYA-DN---EQADIEI  1307
WP_049523028  1243  KRIQ----KKDE-PEHLE--YIKQHHSEFNDLLNFVSEFSQKVLAE--SNLEKIK-N LYI-DN---EQTNMEE-  1302
WP_003107102  1209  SRYTSFSgKEEDrEKHRH--FVESHLHYFDEIKDIIADFSRRYLAD--ANLEKIL-T LYN-EKn---QFSIEEq  1274
WP_054279288  1252  SKRDK---gTQSEnME-----YISNHLHKEKFIEIFPHYIIRYAEKNVIKP--KVIERLN-D TENqKF---NDSDLTEl  1303
WP_049531101  1252  QRIN----KISE-PIHKQ--YVETHQSEFEELLTTIISLSKKYI-QK-PIVESL---LQQ-AF---EQADKDIyq  1310
WP_049538452  1254  QRIN----KISE-PIHKQ--YVEAHQNEFKELLTTIIISLSKKYI-QK-PNVESL---LQQ-AF---EQADNDIyq  1312
WP_049549711  1246  SRYDKLSsKIEseQQKKL--FVEQHLHYFDEILDIVVKHATCVIKAE--NNLKKII-S LYK-KK---EAYSINEq-  1311
WP_007896501  1198  SRYDKLSsKIEseQQKKL--FVEQHLHYFDEILDIVVKHATCVIKAE--NNLKKII-S LYK-KK---EAYSINEq-  1263
EFR44625      1247  KNLH----KLDE-PEHLE--YIQKHRNEFKDLLNLVSEFSQKYLAE--ANLEKIK-D LYA-DN---EQADIEI  1306
WP_002897477  1253  QRIN----KISE-PIHKQ--YVEAHQNEFKELLTTIISLSKKYI-QK-PNVELL---LQQ-AF---DQADKDIyq  1311
WP_002906454  1248  KNVH----KLDE-PGHLE--YIQKHRNEFKDLLNLVSEFSQKYVLAD--ANLEKIK-N LYA-DN---EQADIEI  1307
WP_009729476  1238  QHAN----KEDS----VI--YLEKHRHLSELFHHIIGVSEKTILKP--KVEMTLN-N AFE-KHf--EFDEVSE-  1295
CQR24647      1252  KNVH----KLDE-PEHLE--YIQKHRYEFKDLLNLVSEFSQKYVLAE--ANLEKIK-N LYA-DN---EQADIEI  1311
WP_000066813  1248  KNVH----KLDE-PEHLE--YIQKHRYEFKDLLNLVSEFSQKYVLAE--ANLEKIK-S LYV-DN---EQADIEI  1307
WP_009754323  1241  SNIH----KITE-PIHLN--YVNKNKHEFKELLRHISDFSTRYILAQ--DRLSKIE-E LYD-KN---DGDDISD-  1300
WP_044674937  1243  SNIH----KITE-PIHLN--YVNKNKHEFKELLRHISDFSTRYILAQ--DRLSKIE-E LYD-KN---DGDDISD-  1302
WP_044676715
```

| | | | |
|---|---|---|---|
| WP_044680361 | 1243 | SNIH----KITE-PIHLN--YVNKNKHEFKELLRHISDFSTRYILAQ--DRLSKIE-E LYD-KN---DGDDISD-- | 1302 |
| WP_044681799 | 1241 | SNIH----KITE-PIHLN--YVNKNKHEFKELLRHISDFSTRYILAQ--DRLSKIE-E LYD-KN---DGDDISD-- | 1300 |
| WP_049533112 | 1254 | KRIN----NPIN-KDHIF--YVKKHRDDFKELLNYVLEFNEKYVGAT--KNGERLK-E AVA-DF---DSKSNEE-- | 1313 |
| WP_029909905 | 1182 | STKQA-------DE-AMFLKyyRLEHLEAVFEEL----IRKQAADYQIFE--KLIKKIEvN FYS------c-----TYNEk | 1240 |
| WP_006506696 | 1212 | YNAIYKQ-DYDNlDDIlMi----------QLYIELTNKMKVLYPAY-rGIAEKFE-S YVV-----i----SKEEk | 1268 |
| AIT42264 | 1240 | SHYEKLKgSPEDrEQKQL--FVEQHKHYLDEIIEQISEFSKRVILAD--ANLDKVL-S AYN-KH---RDKPIREq- | 1305 |
| WP_034440723 | 1218 | KHYNE----DE-TSHK--FIVEHKAYFDELLNYIVEFANKYLELE--NSIEKIK-D LYH-----gKGPDVEEke | 1276 |
| AKQ21048 | 1240 | SHYEKLKgSPEDrEQKQL--FVEQHKHYLDEIIEQISEFSKRVILAD--ANLDKVL-S AYN-KH---RDKPIREq- | 1305 |
| WP_004636532 | 1212 | NRYDKVK-------fPDSIE--YVHDNLAKFDDLLEYVIDFSNKYINAD--KNVQKIQ-K IYK-EH---GTEDVEL- | 1271 |
| WP_002364836 | 1218 | KQCLL-----PNQ-SESLA--YVEQHQPEFQEILERVVDFAEVHTLAK--SKVQQIV-K LFE-AN---QTADVKE- | 1277 |
| WP_016631044 | 1169 | KQCLL-----PNQ-SESLA--YVEQHQPEFQEILERVVDFAEVHTLAK--SKVQQIV-K LFE-AN---QTADVKE- | 1228 |
| EM575795 | 954 | QHYDEIAhKESF------D--YVNDHLSFREILDQVIDFSNRYTIA-E KNTEKIA-E LFE-QN---QESTVQS- | 1013 |
| WP_002373311 | 1218 | KQCLL-----PNQ-SESLA--YVEQHQPEFQEILERVVDFAEVHTLAK--SKVQQIV-K LFE-AN---QTADVKE- | 1277 |
| WP_002378009 | 1218 | KQCLL-----PNQ-SESLA--YVEQHQPEFQEILERVVDFAEVHTLAK--SKVQQIV-K LFE-AN---QTADVKE- | 1277 |
| WP_002407324 | 1218 | KQCLL-----PNQ-SESLA--YVEQHQPEFQEILERVVDFAEVHTLAK--SKVQQIV-K LFE-AN---QTADVKE- | 1277 |
| WP_002413717 | 1218 | KQCLL-----PNQ-SESLA--YVEQHQPEFQEILERVVDFAEVHTLAK--SKVQQIV-K LFE-AN---QTADVKE- | 1277 |
| WP_010775580 | 1218 | KQCLL-----PNQ-SESLA--YVEQHQPEFQEILERVVDFAEVHTLAK--SKVQQIV-K LFE-AN---QTADVKE- | 1279 |
| WP_010818269 | 1218 | KQCLL-----PNQ-SESLA--YVEQHQPEFQEILERVVDFAEVHTLAK--SKVQQIV-K LFE-AN---QTADVKE- | 1277 |
| WP_010824395 | 1218 | KQCLL-----PNQ-SESLA--YVEQHQPEFQEILERVVDFAEVHTLAK--SKVQQIV-K LFE-AN---QTADVKE- | 1277 |
| WP_016222645 | 1218 | KQCLL-----PNQ-SESLA--YVEQHQPEFQEILERVVDFAEVHTLAK--SKVQQIV-K LFE-AN---QTADVKE- | 1277 |
| WP_033624816 | 1218 | KQCLL-----PNQ-SESLA--YVEQHQPEFQEILERVVDFAEVHTLAK--SKVQQIV-K LFE-AN---QTADVKE- | 1277 |
| WP_033625576 | 1218 | KQCLL-----PNQ-SESLA--YVEQHQPEFQEILERVVDFAEVHTLAK--SKVQQIV-K LFE-TN---QTADVKE- | 1277 |
| WP_033789179 | 1218 | KQCLL-----PNQ-SESLA--YVEQHQPEFQEILERVVDFAEVHTLAK--SKVQQIV-K LFE-AN---QTDDLAK- | 1277 |
| WP_002310644 | 1220 | KQYDEISHKESF-------D--YVNEHHKEFSEVFARVLEFAGKYTLAE--KNIEKLE-K IYK-EN---QTDDLAK- | 1279 |
| WP_002312694 | 1221 | KQYDEISHKESF-------D--YVNEHHKEFSEVFARVLEFAGKYTLAE--KNIEKLE-K IYK-EN---QTDDLAK- | 1280 |
| WP_002314015 | 1221 | KQYDEISHKESF-------D--YVNEHHKEFSEVFARVLEFAGKYTLAE--KNIEKLE-K IYK-EN---QTDDLAK- | 1280 |
| WP_002320716 | 1221 | KQYDEISHKESF-------D--YVNEHHKEFSEVFARVLEFAGKYTLAE--KNIEKLE-K IYK-EN---QTDDLAK- | 1280 |
| WP_002330729 | 1221 | KQYDEISHKESF-------D--YVNEHHKEFSEVFARVLEFAGKYTLAE--KNIEKLE-K IYK-EN---QTDDLAK- | 1280 |
| WP_002335161 | 1221 | KQYDEISHKESF-------D--YVNEHHKEFSEVFARVLEFAGKYTLAE--KNIEKLE-K IYK-EN---QTDDLAK- | 1280 |
| WP_002345439 | 1221 | KQYDEISHKESF-------D--YVNEHHKEFSEVFARVLEFAGKYTLAE--KNIEKLE-K IYK-EN---QTDDLAK- | 1280 |
| WP_034867970 | 1221 | QHYDKITyQESF-------D--YVNTHLSDFSAILTEVLAFAEKYTLAD--KNIERIQ-E LYE-EN---KYGETSM- | 1270 |
| WP_047937432 | 1221 | KQYDEISHKESF-------D--YVNEHHKEFSEVFARVLEFAGKYTLAE--KNIEKLE-K IYK-EN---QTDDLAK- | 1280 |
| WP_010720994 | 1211 | QHYDKITyQESF-------D--YVNTHLSDFSAILTEVLAFAEKYTLAD--KNIERIQ-E LYE-EN---KYGETSM- | 1270 |
| WP_010737004 | 1211 | QHYDKITyQESF-------D--YVNTHLSDFSAILTEVLAFAEKYTLAD--KNIERIQ-E LYE-EN---KYGETSM- | 1270 |
| WP_034700478 | 1211 | QHYDKITyQESF-------D--YVNTHLSDFSAILTEVLAFAEKYTLAD--KNIERIQ-E LYE-EN---KYGEISM- | 1270 |
| WP_007209003 | 1209 | KKIIN--gKNSD----SVS--YIQNNKEKFREIFEYIVDFSSKYISAD--ANLNKIE-K IFE-NNfh-----KASEqe | 1269 |
| WP_023519017 | 1205 | RHYDEINhKVSF-------D--YVNAHKEGENDIPDFISDEGVRYILAP--QHLEKIK-V AYE-EN---KEVDLKE- | 1264 |
| WP_010770040 | 1216 | KQVDE------DS-GKSEE--YVREHRAEFAEILNYVQAFSETKILAN--KNLQTIL-K LYE-EN---KEADIKE- | 1274 |
| WP_048604708 | 1213 | KHCNE------KP-D-SLK--YVTEHQSGFSEIMAHVKDFAEKYTLVD--KNLEKIL-S LYA-KN---MDSEVKE- | 1270 |
| WP_010750235 | 1214 | NHYDEIAyKDSY-------D--YVNEHFSNFQDILDKVIIFABKYTSAP--QKLNQII-A TYE-KN---QEADRKI- | 1273 |
| AII16583 | 1279 | SHYEKLKgSPEDrEQKQL--FVEQHKHYLDEIIEQISEFSKRVILAD--ANLDKVL-S AYN-KH---RDKPIREq- | 1344 |
| WP_029073316 | 1226 | YKAMKYK-NYSElsQEEIm-------------NVVDIFVEKLKLYYPTY-kNIATNFE-N FEN-----i----SDEEk | 1282 |
| WP_031589969 | 1226 | YKAMKYK-NYDNIdSEKIi-------------DLYRLLINKMELYYPEvFADKYVVAP--KNSEKIR-R LYE-ENq------SIEEk | 1283 |
| KDA45870 | 1200 | NAKDG-------EQKLE---DHKAEFKELFDKiMEFADKYVVAP--KNSEKIR-R LYE-ENq------DATPme | 1253 |
| WP_039099354 | 1242 | LPLTQ-------SEeLAEQV---YDEILDQVMHYFPLYDTNQFrAKLSAGKaA DGN-KMv------QVGQqv | 1306 |
| AKP02966 | 1238 | QIPDE-------DpDQILAf--YDKNILVEILQELITKMKKFYPFY--KNEQEFLaS FNQ-----------ATTSEk | 1296 |
| WP_010991369 | 1216 | ANCEV-----SD-GKSLD--YIESNREMFAELLAHVSEFAKRYTLAE--ANLNKIN-Q LFE-QN---KEGDIKA- | 1274 |
| WP_033838504 | 1219 | ANCEV-----SD-GKSLD--YIESNREMFAELLAHVSEFAKRYTLAE--ANLNKIN-Q LFE-QN---KEGDIKA- | 1277 |
| EHN60060 | 985 | ANCEV-----SD-GKSLD--YIESNREMFAELLAHVSEFAKRYTLAE--ANLNKIN-Q LFE-QN---KEGDIKA- | 1043 |
| EFR89594 | 1216 | KNCEA-----ND-GESLA--YIEMHREMFAELLAYISEFAKRYTLAN--DRLEKIN-M FFE-QN---KKGDIKV- | 1274 |
| WP_038409211 | 835 | KNCEA-----ND-GESLA--YIEMHREMFAELLAYISEFAKRYTLAN--DRLEKIN-M FFE-QN---KKGDIKV- | 893 |
| EFR95520 | 1216 | KNCEA-----SD-GKSLK--YIEAHRETFSELLAQVSEFATRYTLAD--ANLSKIN-N LFE-QN---KEGDIKA- | 1274 |
| WP_003723650 | | | |

-continued

| ID | Start | Sequence | End |
|---|---|---|---|
| WP_003727705 | 1216 | KNCEA------SD-GKSLK--YIEAHRETFSELLAQVSEFATKYTLAD--ANLSKIN-N LFE-QN---KEGDIKA-- | 1274 |
| WP_003730785 | 1216 | KNCEA------SD-GKSLK--YIEAHRETFSELLAQVSEFATKYTLAD--ANLSKIN-N LFE-QN---KEGDIKA-- | 1274 |
| WP_003733029 | 1216 | EKYEA------ID-GESLA--YIEVHRALFDELLAYISEFARKYTLSN--DRLDEIN-M LYE-RN---KDGDVKS-- | 1274 |
| WP_003739838 | 1216 | KNCEA------SD-GKSLD--YIESNREMFGELLAHVSEFAKRYTLAD--ANLSKIN-Q LFE-QN---KDNDIKV-- | 1274 |
| WP_014601172 | 1216 | KNCEA------SD-GKSLK--YIEAHRETFSELLAQVSEFATRYTLAD--ANLSKIN-N LYE-RN---KEGDIQA-- | 1274 |
| WP_023548323 | 1216 | EKREA------ID-GESLA--YIEAHKAVFGELLAHISEFARKYTLAN--DKLDEIN-M LFE-QN---KEGDIKA-- | 1274 |
| WP_031665337 | 1216 | KNCEA------SD-GKSLK--YIEAHRETFSELLAQVSEFATRYTLAD--ANLSKIN-N LFE-RN---KDGDVKS-- | 1274 |
| WP_031669209 | 1216 | EKYEA------ID-GESLA--YIEVHRALFDELLAYISEFARKYTLSN--DRLDEIN-M LYE-RN---KDGDVKS-- | 1274 |
| WP_033920898 | 1216 | EKREA------ID-GESLA--YIEAHKAVFGELLAHISEFARKYTLAN--DKLDEIN-M LYE-RN---KDGDVKS-- | 1274 |
| AKI42028 | 1216 | KNCEA------SD-GKSLK--YIEAHRETFSELLAQVSEFATRYTLAD--ANLSKIN-N LFE-QN---KDGDVKS-- | 1274 |
| AKI50529 | 1219 | EKREA------ID-GESLA--YIEAHKAVFGELLAHISEFARKYTLAN--DKLDEIN-M LYE-RN---KDGDVKS-- | 1277 |
| EFR83390 | 664 | KNCEA------SD-GKSLK--YTEAHRETFSELLAQVSEFATRYTLAD--ANLSKIN-N LFE-QN---KEGDIKX-- | 722 |
| WP_046323366 | 1216 | KNCEA------SD-GKSLA--YIESHREMFAEHLDSISEFASRYTLAD--ANLEKIN-T IFE-QN---KSGDVKV-- | 1274 |
| AKE81011 | 1256 | SHYEKLkgSPEDREQKQL-FVEQHKHYLDEIIEQISEFSKRVILAD--ANLDKVL-S AYN-KH--RDKPIREq | 1321 |
| CUO82355 | 1216 | YNAIYKQ-DFDG1DNMLMi----------QLYLQLQKMDTLYPAY-kGIAKRFF-D FKN-----SKEEk | 1272 |
| WP_031162887 | 1218 | YAAMLKK-RYEY1DEEEIf----------DLYLQLQKMDTLYPAY-kGIAKRFF-D FKN------i----DVVEk | 1274 |
| AGZ01981 | 1273 | SHYEKLkgSPEDREQKQL-FVEQHKHYLDEIIEQISEFSKRVILAD--ANLDKVL-S AYN-KH--RDKPIREq | 1338 |
| AKA60242 | 1240 | SHYEKLkgSPEDREQKQL-FVEQHKHYLDEIIEQISEFSKRVILAD--ANLDKVL-S AYN-KH--RDKPIREq | 1305 |
| AK540380 | 1240 | SHYEKLkgSPEDREQKQL-FVEQHKHYLDEIIEQISEFSKRVILAD--ANLDKVL-S AYN-KH--RDKPIREq | 1305 |
| 4UN5_B | 1244 | SHYEKLkgSPEDREQKQL-FVEQHKHYLDEIIEQISEFSKRVILAD--ANLDKVL-S AYN-KH--RDKPIREq | 1309 |
| WP_010922251 | 1306 | -AE---NII HLFTLTNLGAP-AAFKYFD-TTI---DRK--R-YTSTKEVL DATLIHQSITGLYETRIDLSQL- | 1365 |
| WP_039695303 | 1309 | ISN---SFI NLLTLTALGAP-ADFNFLG--EKI--PRK--R-YTSTKECL NATLIHQSITGLYETRIDLSKL- | 1369 |
| WP_045635197 | 1307 | LAN---SFI NLLTFTAFGAP-AAFKFFG--KDI--DRK--R-YTTVSEIL NATLIHQSITGLYETWIDLSKL- | 1367 |
| 5AXW_A | | | |
| WP_009880683 | 990 | -AE---NII HLFTLTNLGAP-AAFKCFD--TTI---GRN--R-YKSIKEVL DATLIHQSITGLYETRIDLSQL- | 1049 |
| WP_010922251 | 1306 | -AE---NII HLFTLTNLGAP-AAFKYFD--TTI---DRK--R-YTSTKEVL DATLIHQSITGLYETRIDLSQL- | 1365 |
| WP_011054416 | 1306 | -AE---NII HLFTLTNLGAP-AAFKYFD--TTI---DRK--R-YTSTKEVL DATLIHQSITGLYETRIDLSQL- | 1365 |
| WP_011284745 | 1306 | -AE---NII HLFTLTNLGAP-AAFKYFD--TTI---DRK--R-YTSTKEVL DATFIHQSITGLYETRIDLSQL- | 1365 |
| WP_011285506 | 1306 | -AE---NII HLFTLTNLGAP-AAFKYFD--TTI---DRK--R-YTSTKEVL DATLIHQSITGLYETRIDLSQL- | 1365 |
| WP_011527619 | 1306 | -AE---NII HLFTLTNFGAP-TAFKYFD--TTI---GRN--R-YKSIKEVL DATLIHQSITGLYETRIDLSQL- | 1365 |
| WP_012560673 | 1306 | -AE---NII HLFTLTNLGAP-AAFKCFD--TTI---GRN--R-YKSIKEVL DATLIHQSITGLYETRIDLSQL- | 1365 |
| WP_014407541 | 1306 | -AE---NII HLFTLTNLGAP-AAFKYFD--TTI---DRK--R-YTSTKEVL DATLIHQSITGLYETRIDLSQL- | 1364 |
| WP_020905136 | 1306 | -AE---NII HLFTLTNLGAP-AAFKYFD--TTI---DRK--R-YTSTKEVL DATLIHQSITGLYETRIDLSQL- | 1365 |
| WP_023080005 | 1306 | -AK---NII HLFTLTNLGAP-AAFKYFD--TTI---ERN--R-YKSIKEVL DATLIHQSITGLYETRIDLSQL- | 1364 |
| WP_023610282 | 1305 | -AK---NII HLFTLTNLGAP-AAFKYFD--TTI---ERN--R-YKSIKEVL DATLIHQSITGLYEIRIDLSQL- | 1364 |
| WP_030125963 | 1306 | -AE---NII HLFTLTNLGAP-AAFKYFD--TTI---GRN--R-YKSIKEVL DATLIHQSITGLYETRIDLSQL- | 1365 |
| WP_030126706 | 1306 | -AE---NII HLFTLTNLGAP-AAFKYFD--TTI---DRK--R-YTSTKEVL DATLIHQSITGLYETRIDLSQL- | 1365 |
| WP_031488318 | 1306 | -AE---NII HLFTLTNLGAP-AAFIYFD--TTI---GRN--R-YKSIKEVL DATLIHQSITGLYETRIDLSQL- | 1365 |
| WP_032460140 | 1306 | -AE---NII HLFTLTNLGAP-AAFKYFD--TTI---GRN--R-YKSIKEVL DATLIHQSITGLYETRIDLSQL- | 1365 |
| WP_032461047 | 1306 | -AE---NII HLFTLTNLGAP-AAFKYFD--TTI---DRK--R-YTSTKEVL DATLIHQSITGLYETRIDLSQL- | 1365 |
| WP_032462016 | 1306 | -AE---NII HLFTLTNLGAP-AAFKYFD--TTI---DRK--R-YTSTKEVL DATLIHQSITGLYETRIDLSQL- | 1364 |
| WP_032462936 | 1306 | -AE---NII HLFTLTNLGAP-AAFKYFD--TTI---DRK--R-YTSTKEVL DATLIHQSITGLYETRIDLSQL- | 1365 |
| WP_032464890 | 1131 | -AE---NII HLFTLTNLGAP-TAFKYFD--TTI---DRK--R-YTSTKEVL DATLIHQSITGLYETRIDLSQL- | 1190 |
| WP_033888930 | 1306 | -AE---NII HLFTLTNLGAP-AAFNFFG--ENI---DRK--R-YTSVTECL NATLIHQSITGLYETRIDLSKL- | 1365 |
| WP_038431314 | 1306 | -AE---NII HLFTLTNLGAP-AAFKYFD--TTI---DRK--R-YTSTKEVL DATFIHQSITGLYETRIDLSQL- | 1364 |
| WP_038432938 | 1305 | -AK---NII HLFTLTNLGAP-AAFKYFD--TTI---ERN--R-YKSIKEVL DATLIHQSITGLYETRIDLSQL- | 1364 |
| WP_038434062 | 1306 | -AE---NII HLFTLTNLGAP-AAFKYFD--TTI---GRN--R-YKSIKEVL DATLIHQSITGLYETRIDLSQL- | 1365 |
| BAQ51233 | 1217 | -AE---NII HLFTLTNLGAP-AAFKYFD--TTI---DRK--R-YTSTKEVL DATLIHQSITGLYETRIDLSQL- | 1276 |
| KGE60162 | 481 | -AE---NII HLFTLTNLGAP-AAFKYFD--TTI---DRK--R-YTSTKEVL DATLIHQSITGLYETRIDLSQL- | 540 |
| KGE60856 | 244 | -AE---NII HLFTLTNLGAP-AAFKYFD--TTI---DRK--R-YTSTKEVL DATLIHQSITGLYETRIDLSQL- | 303 |
| WP_002989955 | 1306 | -AE---NII HLFTLTNLGAP-AAFKYFD--TTI---DRK--R-YTSTKEVL DATLIHQSITGLYETRIDLSQL- | 1365 |
| WP_003030002 | 1282 | LAK---SFI SLLTFTAFGAP-AAFNFFG--EKI--DRK--R-YTSVTECL NATLIHQSITGLYETRIDLSKL- | 1342 |
| WP_003065552 | 1310 | ISN---SFI NLLTLTALGAP-ADFNFLG--EKI--PRK--R-YTSTKECL NATLIHQSITGLYETRIDLSKI- | 1370 |

-continued

| ID | | | | | |
|---|---|---|---|---|---|
| WP_001040076 | 1307 | LAN---NII NLFTFTSLGAP-AAFKFFD--KIV--DRK--R-YTSTKEVL NSTLIHQSITGLYETRIDLGKL-- | 1367 |
| WP_001040078 | 1315 | LAN---NII NLFTFTSLGAP-AAFKFFD--KIV--DRK--R-YTSTKEVL NSTLIHQSITGLYETRIDLSKL-- | 1375 |
| WP_001040080 | 1307 | LAN---NII NLFTFTSLGAP-AAFKFFD--KIV--DRK--R-YTSTKEVL NSTLIHQSITGLYETRIDLGKL-- | 1367 |
| WP_001040081 | 1307 | LAN---NII NLFTFTSLGAP-AAFKFFD--KIV--DRK--R-YTSTKEVL NSTLIHQSITGLYETRIDLGKL-- | 1367 |
| WP_001040083 | 1307 | LAN---NII NLFTFTSLGAP-AAFKFFD--KIV--DRK--R-YTSTKEVL NSTLIHQSITGLYETRIDLGKL-- | 1367 |
| WP_001040085 | 1307 | LAN---NII NLFTFTSLGAP-AAFKFFD--KIV--DRK--R-YTSTKEVL NSTLIHQSITGLYETRIDLGKL-- | 1367 |
| WP_001040087 | 1307 | LAN---NII NLFTFTSLGAP-AAFKFFD--KIV--DRK--R-YTSTKEVL NSTLIHQSITGLYETRIDLGKL-- | 1367 |
| WP_001040088 | 1307 | LAN---NII NLFTFTSLGAP-AAFKFFD--KIV--DRK--R-YTSTKEVL NSTLIHQSITGLYETRIDLGKL-- | 1367 |
| WP_001040089 | 1307 | LAN---NII NLFTFTSLGAP-AAFKFFD--KIV--DRK--R-YTSTKEVL NSTLIHQSITGLYETRIDLGKL-- | 1367 |
| WP_001040090 | 1307 | LAN---NII NLFTFTSLGAP-AAFKFFD--KIV--DRK--R-YTSTKEVL NSTLIHQSITGLYETRIDLGKL-- | 1367 |
| WP_001040091 | 1307 | LAN---NII NLFTFTSLGAP-AAFKFFD--KIV--DRK--R-YTSTKEVL NSTLIHQSITGLYETRIDLGKL-- | 1367 |
| WP_001040092 | 1307 | LAK---NII NLFTFTSLGAP-AAFKFFD--KSV--DRK--R-YTSTKEVL DSTLIHQSITGLYETRIDLGKL-- | 1367 |
| WP_001040094 | 1307 | LAN---NII NLFTFTSLGAP-AAFKFFD--KIV--DRK--R-YTSTKEVL NSTLIHQSITGLYETRIDLGKL-- | 1367 |
| WP_001040095 | 1307 | LAN---NII NLFTFTSLGAP-AAFKFFD--KIV--DRK--R-YTSTKEVL NSTLIHQSITGLYETRIDLGKL-- | 1367 |
| WP_001040096 | 1307 | LAN---NII NLFTFTSLGAP-AAFKFFD--KIV--DRK--R-YTSTKEVL NSTLIHQSITGLYETRIDLGKL-- | 1367 |
| WP_001040097 | 1307 | LAN---NII NLFTFTSLGAP-AAFKFFD--KIV--DRK--R-YTSTKEVL NSTLIHKSITGLYETRIDLGKL-- | 1367 |
| WP_001040098 | 1307 | LAN---NII NLFTFTSLGAP-AAFKFFD--KIV--DRK--R-YTSTKEVL NSTLIHQSITGLYETRIDLGKL-- | 1367 |
| WP_001040099 | 1307 | LAN---NII NLFTFTSLGAP-AAFKFFD--KIV--DRK--R-YTSTKEVL DSTLIHQSITGLYETRIDLGKL-- | 1367 |
| WP_001040100 | 1307 | LAN---NII NLFTFTSLGAP-AAFKFFD--KIV--DRK--R-YTSTKEVL NSTLIHQFITGLYETRIDLGKL-- | 1367 |
| WP_001040104 | 1307 | LAN---NII NLFTFTSLGAP-AAFKFFD--KIV--DRK--R-YTSTKEVL NSTLIHQSITGLYETRIDLGKL-- | 1367 |
| WP_001040105 | 1307 | LAN---NII NLFTFTSLGAP-AAFKFFD--KSV--DRK--R-YTSTKEVL NSTLIHQSITGLYETRIDLGKL-- | 1367 |
| WP_001040106 | 1307 | LAK---NII NLFTFTSLGAP-AAFKFFD--KIV--DRK--R-YTSTKEVL NSTLIHQSITGLYETRIDLGKL-- | 1367 |
| WP_001040107 | 1307 | LAN---NII NLFTFTSLGAP-AAFKFFD--KIV--DRK--R-YTSTKEVL NSTLIHQSITGLYETRIDLGKL-- | 1367 |
| WP_001040108 | 1307 | LAN---NII NLFTFTSLGAP-AAFKFFD--KIV--DRK--R-YTSTKEVL NSTLIHQSITGLYETRIDLGKL-- | 1367 |
| WP_001040109 | 1307 | LAN---NII NLFTFTSLGAP-AAFKFFD--KIV--DRK--R-YTSTKEVL NSTLIHQSITGLYETRIDLGKL-- | 1367 |
| WP_001040110 | 1307 | LAN---NII NLFTFTSLGAP-AAFKFFD--KIV--DRK--R-YTSTKEVL NSTLIHQSITGLYETRIDLGKL-- | 1367 |
| WP_015058523 | 1307 | LAN---NII NLFTFTSLGAP-AAFKFFD--KIV--DRK--R-YTSTKEVL NSTLIHQSITGLYETRIDLGKL-- | 1367 |
| WP_017643650 | 1307 | LAN---NII NLFTFTSLGAP-AAFKFFD--KIV--DRK--R-YTSTKEVL NSTLIHQSITGLYETRIDLGKL-- | 1367 |
| WP_017647151 | 1307 | LAN---NII NLFTFTSLGAP-AAFKFFD--KIV--DRK--R-YTSTKEVL NSTLIHQSITGLYETRIDLGKL-- | 1367 |
| WP_017648376 | 1307 | LAN---NII NLFTFTSLGAP-AAFKFFD--KIV--DRK--R-YTSTKEVL NSTLIHQSITGLYETRIDLGKL-- | 1367 |
| WP_017649527 | 1307 | LAN---NII NLFTFTSLGAP-AAFKFFD--KIV--DRK--R-YTSTKEVL NSTLIHQSITGLYETRIDLGKL-- | 1367 |
| WP_017771611 | 1307 | LAN---NII NLFTFTSLGAP-AAFKFFD--KIV--DRK--R-YTSTKEVL NSTLIHQSITGLYETRIDLGKL-- | 1367 |
| WP_017771984 | 1307 | LAN---NII NLFTFTSLGAP-AAFKFFD--KIV--DRK--R-YTSTKEVL NSTLIHQSITGLYETRIDLGKL-- | 1367 |
| CFQ25032 | 1307 | LAN---NII NLFTFTSLGAP-AAFKFFD--KIV--DRK--R-YTSTKEVL NSTLIHQSITGLYETRIDLGKL-- | 1367 |
| CFV16040 | 1307 | LAN---NII NLFTFTSLGAP-AAFKFFD--KIV--DRK--R-YTSTKEVL NSTLIHQSITGLYETRIDLGKL-- | 1367 |
| KLJ37842 | 1307 | LAN---NII NLFTFTSLGAP-AAFKFFD--KIV--DRK--R-YTSTKEVL NSTLIHQSITGLYETRIDLGKL-- | 1367 |
| KLJ72361 | 1307 | LAN---NII NLFTFTSLGAP-AAFKFFD--KIV--DRK--R-YTSTKEVL NSTLIHQSITGLYETRIDLGKL-- | 1367 |
| KLL20707 | 1321 | LAN---NII NLFTFTSLGAP-AAFKFFD--KIV--DRK--R-YTSTKEVL NSTLIHQSITGLYETRIDLGKL-- | 1381 |
| KLL42645 | 1307 | LAN---NII NLFTFTSLGAP-AAFKFFD--KIV--DRK--R-YTSTKEVL NSTLIHQSITGLYETRIDLGKL-- | 1367 |
| WP_047207273 | 1307 | LAN---NII NLFTFTSLGAP-AAFKFFD--KIV--DRK--R-YTSTKEVL NSTLIHQSITGLYETRIDLGKL-- | 1367 |
| WP_047209694 | 1307 | LAN---NII NLFTFTSLGAP-AAFKFFD--KIV--DRK--R-YTSTKEVL NSTLIHQSITGLYETRIDLGKL-- | 1367 |
| WP_050198062 | 1307 | LAN---NII NLFTFTSLGAP-AAFKFFD--KII--DRK--R-YTSTKEVL NSTLIHQSITGLYETRIDLGKL-- | 1367 |
| WP_050201642 | 1307 | LAN---NII NLFTFTSLGAP-AAFKFFD--KIV--DRK--R-YTSTKEVL NSTLIHQSITGLYETRIDLGKL-- | 1367 |
| WP_050204027 | 1307 | LAN---NII NLFTFTSLGAP-AAFKFFD--KSV--DRK--R-YTSTKEVL DSTLIHQSITGLYETRIDLGKL-- | 1367 |
| WP_050881965 | 1307 | LAN---NII NLFTFTSLGAP-AAFKFFD--KIV--DRK--R-YTSTKEVL NSTLIHQSITGLYETRIDLGKL-- | 1367 |
| WP_050886065 | 1307 | LAN---NII NLFTFTSLGAP-AAFKFFD--KIV--DRK--R-YTSTKEVL NSTLIHQSITGLYETRIDLGKL-- | 1367 |
| AHN30376 | 1307 | LAN---NII NLFTFTSLGAP-AAFKFFD--KIV--DRK--R-YTSTKEVL NSTLIHQSITGLYETRIDLGKL-- | 1367 |
| EA078426 | 1307 | LAN---NII NLFTFTSLGAP-AAFKFFD--KIV--DRK--R-YTSTKEVL NSTLIHQSITGLYETRIDLGKL-- | 1367 |
| CCW42055 | 1314 | ICT---SFL GLFELTSLGSA-SDFEFLG--VKI--PRY--RAYTPSSLLK DSTLIHQSITGLYETRIDLSKL-- | 1383 |
| WP_003041502 | 1283 | LAK---SFI SLLTFTAFGAP-AAFNFFG--ENI--DRK--R-YTSVTECL NATLIHQSITGLYETRIDLSKL-- | 1343 |
| WP_037593752 | 1283 | LAK---SFI SLLTFTAFGAP-AAFNFFG--ENI--DRK--R-YTSVTECL NATLIHQSITGLYETRIDLSKL-- | 1343 |
| WP_049516684 | 1282 | LAK---SFI SLLTFTAFGAP-AAFNFFG--ENI--DRK--R-YTSVTECL NATLIHQSITGLYETRIDLSKL-- | 1342 |
| GAD46167 | | | |

```
                                                              -continued
WP_018363470   1314  ISD---SFI NLLTLTALGAP-ADFNFLG--BKI--PRK--R-YNSTKECL NATLIHQSITGLYETRIDLSKL--  1374
WP_003043819   1311  -SN---SFV SLLKYTSFGAS-GGFTFLD--LDVkqGRLl-R-YQTVTEVL DATLIYQSITGLYETRTDLSQL--  1372
WP_006269658   1282  LAK---SFI SLLTFTAFGAP-AAFNFFG--DRK--R-YTSVTECL NATLIHQSITGLYETRIDLSKL--  1342
WP_048800889   1302  ISN---SFI HLLTLTALGAP-ADFNFJG--EKI--PRK--R-YTSTKECL NATLIHQSITGLYETRIDLSKL--  1362
WP_012767106   1309  -CS---SVI NLLTLTASGAP-ADFKFLG--TTI--PRK--R-YGSPQSIL SSTLIHQSITGLYETRIDLSQL--  1368
WP_014612333   1309  -CS---SVI NLLTLTASGAP-ADFKFLG--TTI--PRK--R-YGSPQSIL SSTLIHQSITGLYETRIDLSQL--  1368
WP_015017095   1309  -CS---SVI NLLTLTASGAP-ADFKFLG--TTI--PRK--R-YGSPQSIL SSTLIHQSITGLYETRIDLSQL--  1368
WP_015057649   1309  -CS---SVI NLLTLTASGAP-ADFKFLG--TTI--PRK--R-YGSPQSIL SSTLIHQSITGLYETRIDLSQL--  1368
WP_048272215   1309  -CS---SVI NLLTLTASGAP-ADFKFLG--TTI--PRK--R-YGSPQSIL SSTLIHQSITGLYETRIDLSQL--  1368
WP_049519324   1286  -AE---NII NVFTFVALGAP-AAFKFPD--ATI--DRK--R-YTSTKEVL NATLIHQSVTGLYETRIDLSQL--  1345
WP_012515931   1286  -AE---NII NVFTFVALGAP-AAFNFFG--ATI--DRK--R-YTSTKEVL NATLIHQSVTGLYETRIDLSKL--  1345
WP_021320964   1286  -AE---NII NVFTFVALGAP-AAFKFPD--ATI--DRK--R-YTSTKEVL NATLIHQSVTGLYETRIDLSKL--  1345
WP_037581760   1309  ISSlseSFI NLLKFISFGAP-GAFKFLK--KQSnlR-YKSTTEAL SATLIHQSVTGLYETRIDLSKL--  1374
WP_004232481   1307  ISN---SFI NLLTLTALGAP-ADFNFLG--LDV--KQSnlR-YKSTTECL TATLIHQSITGLYETRIDLSKL--  1367
WP_009854540   1308  ISI---SFV NLLTLTALGAP-ADFKFLG--EKI--PRK--R-YTSTKECL NATLIHQSITGLYETRIDLSKL--  1368
WP_012962174   1308  ISN---SFI NLLTLTALGAP-ADFNFLG--EKI--PRK--R-YTSTKECL NATLIHQSITGLYETRIDLSKL--  1369
WP_039695303   1312  ISA---SFI NLLTLTALGAP-ADFNFLG--EKI--PRK--R-YTSTKECL SATLIHQSVTGLYETRIDLSKL--  1372
WP_014334983   1306  -AI---NML NLPTFTDLGAP-SAFKFFN--GDI--DRK--R-YSSTNEII NSTLIYQSPTGLYETRIDLSKL--  1365
AHY17476              -------- ---------- ---- --- -- --------- -------------------
AHY17476        138  -AI---NML NLPTFTDLGAP-SAFKFFNg-DI--DRK--R-YSSTNEII NSTLIYQSPTGLYETRIDLSRL--   197
ESR09100              -------- ---------- ---- --- -- --------- -------------------
AGM98575       1282  -SFV--SFI NLLTFTAIGAP-AAFKFFD--NNI--DRK--R-YTSTTEIL NATLIHQSITGLYETRIDLSKL--  1342
ALF27331       1290  VAR---SFV -LLNFTMMGAA-TDFKFPG--QII--PRK--R-YPSTTECL KSTLIHQSITGLYETRIDLSKL--  1350
WP_018372492   1311  LSE---SFI SLLKLISFGAP-GTFKFLG--VEI--SQSnvR-YQSVSSCF NATLIHQSITGLYETRIDLSKL--  1373
WP_045618028   1307  LAN---SFI NLLTFTAIGAP-AAFKFPG--KDI--DRK--R-YTTVSEIL NATLIHQSITGLYETWIDLSKL--  1367
WP_045635197   1282  LAS---SFI NLLTFTAIGAP-ATFKFFD--KNI--DRK--R-YTSTTEIL NATLIHQSITGLYETRIDLNKL--  1342
WP_002263549   1282  LAS---SFI NLLTFTAIGAP-AAFKFFD--KNI--DRK--R-YTSTTEIL NATLIHQSITGLYETRIDLSKL--  1342
WP_002263887   1282  LAS---SFI NLLTFTAIGAP-ATFKFFD--KNI--DRK--R-YTSTTEIL NATLIHQSITGLYETRIDLNKL--  1342
WP_002264920   1282  LAS---SFI NLLTFTAIGAP-ATFKFFD--KNI--DRK--R-YTSTTEIL NATLIHQSITGLYETRIDLSKL--  1342
WP_002269043   1282  LAS---SFI NLLTFTAIGAP-ATFKFFD--KNI--DRK--R-YTSTTEIL NATLIHQSITGLYETRIDLSKL--  1342
WP_002269448   1282  LAS---SFI NLLTFTAIGAP-ATFKFFD--KNI--DRK--R-YTSTTEIL NATLIHQSITGLYETRIDLSKL--  1342
WP_002271977   1282  LAS---SFI NLLTFTAIGAP-ATFKFFD--KNI--DRK--R-YTSTTEIL NATLIHQSITGLYETRIDLSKL--  1342
WP_002272766   1282  LAS---SFI NLLTFTAIGAP-ATFKFFD--KNI--DRK--R-YTSTTEIL NATLIHQSITGLYETRIDLSKL--  1342
WP_002273241   1282  LAS---SFI NLLTFTAIGAP-ATFKFFD--KNI--DRK--R-YTSTTEIL NATLIHQSITGLYETRIDLSKL--  1342
WP_002275430   1282  LAS---SFI NLLTFTAIGAP-AAFKFFD--KNI--DRK--R-YTSTTEIL NATLIHQSITGLYETRIDLSKL--  1342
WP_002276448   1282  LAS---SFI NLLTFTAIGAP-ATFKFFD--KNI--DRK--R-YTSTTEIL NATLIHQSITGLYETRIDLNKL--  1342
WP_002277050   1288  LAD---GFI KLLGFTQLGAT-SPFSFLG--IKL--NQK--Q-YTGKKDYL EATLIHQSITGLYETRIDLNKL--  1352
WP_002773364   1282  LAS---SFI NLLTFTAIGAP-ATFKFFD--KNI--DRK--R-YTSTTEIL NATLIHQSITGLYETRIDLSKL--  1342
WP_002279025   1282  LAS---SFI NLLTFTAIGAP-ATFKFFD--KNI--DRK--R-YTSTTEIL NATLIHQSITGLYETRIDLSKL--  1342
WP_002279859   1282  LAS---SFI NLLTFTAIGAP-ATFKFFD--KNI--DRK--R-YTSTTEIL NATLIHQSITGLYETRIDLSKL--  1342
WP_002280230   1282  LAS---SFI NLLTFTAIGAP-ATFKFFD--KNI--DRK--R-YTSTTEIL NATLIHQSITGLYETRIDLSKL--  1342
WP_002281696   1282  LSS---SFI NLLTFTAIGAP-ATFKFFD--KNI--DRK--R-YTSTTEIL NATLIHQSITGLYETRIDLSKL--  1342
WP_002282247   1288  LAD---GFI KLLGFTQLGAT-SPFSFLG--IKL--NQK--Q-YTGKKDYL EATLIHQSITGLYETRIDLSKL--  1352
WP_002282906   1282  LAS---SFI NLLTFTAIGAP-ATFKFFD--KNI--DRK--R-YTSTTEIL NATLIHQSITGLYETRIDLSKL--  1342
WP_002283846   1282  LAS---SFI NLLTFTAIGAP-ATFKFFD--KNI--DRK--R-YTSTTEIL NATLIHQSITGLYETRIDLSKL--  1342
WP_002287255   1282  LAS---SFI NLLTFTAIGAP-ATFKFFD--KNI--DRK--R-YTSTTEIL NATLIHQSITGLYETRIDLSKL--  1342
WP_002288990   1282  LAS---SFI NLLTFTAIGAP-ATFKFFD--KNI--DRK--R-YTSTTEIL NATLIHQSITGLYETRIDLSKL--  1342
WP_002289641   1282  LAS---SFI NLLTFTAIGAP-ATFKFFD--KNI--DRK--R-YTSTTEIL NATLIHQSITGLYETRIDLSKL--  1342
WP_002290427   1282  LAS---SFI NLLTFTAIGAP-ATFKFFD--KNI--DRK--R-YTSTTEIL NATLIHQSITGLYETRIDLSKL--  1342
WP_002295753   1282  LAS---SFI NLLTFTAIGAP-ATFKFFD--KNI--DRK--R-YTSTTEIL NATLIHQSITGLYETRIDLSKL--  1342
WP_002296423   1282  LAS---SFI NLLTFTAIGAP-ATFKFFD--KNI--DRK--R-YTSTTEIL NATLIHQSITGLYETRIDLSKL--  1342
WP_002304487   1296  LAS---SFI NLLTFTAIGAP-AAFKFFD--KNI--DRK--R-YTSTTEIL NATLIHQSITGLYETRIDLNKL--  1356
```

-continued

| | | | | | | | | |
|---|---|---|---|---|---|---|---|---|
| WP_002305844 | 1282 | LAS---SFI | NLLTFTAIGAP-ATFKFFD--KNI--DRK-R-YTSTTEIL | NATLIHQSITGLYETRIDLSKL-- | 1342 |
| WP_002307203 | 1282 | LAS---SFI | NLLTFTAIGAP-ATFKFFD--KNI--DRK-R-YTSTTEIL | NATLIHQSITGLYETRIDLSKL-- | 1342 |
| WP_002310390 | 1282 | LAS---SFI | NLLTFTAIGAP-ATFKFFD--KNI--DRK-R-YTSTTEIL | NATLIHQSITGLYETRIDLSKL-- | 1342 |
| WP_002352408 | 1282 | LAS---SFI | NLLTFTAIGAP-ATFKFFD--KNI--DRK-R-YTSTTEIL | NATLIHQSITGLYETRIDLSKL-- | 1342 |
| WP_012997688 | 1282 | LAS---SFI | NLLTFTAIGAP-ATFKFFD--KNI--DRK-R-YTSTTEIL | NATLIHQSITGLYETRIDLSKL-- | 1342 |
| WP_014677909 | 1282 | LAS---SFI | NLLTFTAIGAP-ATFKFFD--KNI--DRK-R-YTSTTEIL | NATLIHQSITGLYETRIDLSKL-- | 1342 |
| WP_019312892 | 1282 | LAS---SFI | NLLTFTAIGAP-ATFKFFD--KNI--DRK-R-YTSTTEIL | NATLIHQSITGLYETRIDLSKL-- | 1342 |
| WP_019313659 | 1282 | LAS---SFI | NLLTFTAIGAP-ATFKFFD--KNI--DRK-R-YTSTTEIL | NATLIHQSITGLYETRIDLSKL-- | 1342 |
| WP_019314093 | 1282 | LAS---SFI | NLLTFTAIGAP-ATFKFFD--KNI--DRK-R-YTSTTEIL | NATLIHQSITGLYETRIDLSKL-- | 1342 |
| WP_019315370 | 1282 | LSS---SFI | NLLTFTAIGAP-AAFKFFD--KNI--DRK-R-YTSTTEIL | NATLIHQSITGLYETRIDLNKL-- | 1342 |
| WP_019803776 | 1282 | LAS---SFI | NLLTFTAIGAP-ATFKFFD--KNI--DRK-R-YTSTTEIL | NATLIHQSITGLYETRIDLNKL-- | 1342 |
| WP_019805234 | 1282 | LAS---SFI | NLLTFTAIGAP-ATFKFFD--KNI--DRK-R-YTSTTEIL | NATLIHQSITGLYETRIDLSKL-- | 1342 |
| WP_024783594 | 1282 | LAS---SFI | NLLTFTAIGAP-ATFKFFD--KNI--DRK-R-YTSTTEIL | NATLIHQSITGLYETRIDLSKL-- | 1342 |
| WP_024784288 | 1288 | LAD---GFI | KLLGFTQLGAT-SPFSFLG--IKL--NQK--Q-YTGKKDYL | EATLIHQSITGLYETRIDLSKL-- | 1352 |
| WP_024784666 | 1282 | LAS---SFI | NLLTFTAIGAP-ATFKFFD--KNI--DRK-R-YTSTTEIL | NATLIHQSITGLYETRIDLSKL-- | 1342 |
| WP_024784894 | 1282 | LAS---SFI | NLLTFTAIGAP-ATFKFFD--KNI--DRK-R-YTSTTEIL | NATLIHQSITGLYETRIDLSKL-- | 1342 |
| WP_024786433 | 1288 | LAD---GFI | KLLGFTQLGAT-SPFSFLG--IKL--NQK--Q-YTGKKDYL | EATLIHQSITGLYETRIDLSKL-- | 1352 |
| WP_049473442 | 1282 | LAS---SFI | NLLTFTAIGAP-ATFKFFD--KNI--DRK-R-YTSTTEIL | NATLIHQSITGLYETRIDLSKL-- | 1342 |
| WP_049745547 | 1282 | LAS---SFI | NLLTFTAIGAP-ATFKFFD--KNI--DRK-R-YTSTTEIL | KATLIHQSITGLYETRIDLSKL-- | 1342 |
| EMC03581 | 1275 | LAS---SFI | NLLTFTAIGAP-ATFKFFD--KNI--DRK-R-YTSTTEIL | NATLIHQSITGLYETRIDLSKL-- | 1335 |
| WP_000428612 | 1310 | LAN---SFI | NLLTFSLGAP-AAFKFPG--KDV--DRK-R-YTTVSEIL | NATLIHQSITGLYETRIDLSKL-- | 1370 |
| WP_000428613 | 1308 | LSE---SFI | SLLKLTSPGAP-AAFKFLG--VEI--SQSsvR-YKPNSQFL | DTTLIHQSITGLYETRIDLSKL-- | 1368 |
| WP_049523028 | 1303 | IAN---SFI | NLLTFTAPGAP-AVFKFFG--KDI--ERK-R-YSTVTEIL | KATLIHQSLTGLYETRIDLSKL-- | 1363 |
| WP_003107102 | 1275 | -AT---NML | NLPFTFTGLGAP-ATLKFFN--VDI--DRK-R-YTSSTEIL | NSTLIRQSITGLYETRIDLSKL-- | 1334 |
| WP_054279298 | 1304 | -SI---SFL | NLPFKFTSPGAP-BKFTFLN--SEIkqDDV-R-YRSTKECL | NSTLIHQSVTGLYETRIDLSQF-- | 1365 |
| WP_049531101 | 1311 | LSE---SFI | SLLKLTSPGAP-GAFRFLG--VEI--SQSnvR-YQSVSSCF | NATLIHQSITGLYETRIDLSKL-- | 1373 |
| WP_049538452 | 1313 | LSE---SFI | SLLKLTSPGAP-GAFKFLG--VEI--SQSsvR-YKPNSQFL | DATLIHQSITGLYETRIDLSKL-- | 1373 |
| WP_049549711 | 1313 | LSE---SFI | SLLKLTSPGAP-GAFKFLG--AEI--SQSsvR-YKPNSQFL | EDTLIHQSITGLYETRIDLSKL-- | 1375 |
| WP_007896501 | 1312 | -AL---NML | NLFIFTSIGAP-STFVFFD--ETI--DRK-R-YTTSSDVL | NGILQQSITGLYETRIDLSRP-- | 1371 |
| EFR44625 | 1264 | -AL---NML | NLFIFTSIGAP-STFVFFD--ETI--DRK-R-YTTSSDVL | NGILIQQSITGLYETRIDLSRF-- | 1323 |
| WP_002897477 | 1307 | LAN---SFI | NLLTFTAIGAP-AAFKFPG--KDV--DRK-R-YTTVSEIL | DTTLIHQSITGLYETRIDLSKL-- | 1367 |
| WP_002906454 | 1312 | LSE---SFI | SLLKLTSPGAP-GAFKFLG--VEI--SQSsvR-YKPNSQFL | DSTLIHQSITGLYETRIDLSKL-- | 1374 |
| WP_009729476 | 1308 | LAN---SFI | NLLTFTAIGAP-AAFKFPG--KDV--DRK-R-YTTVSEIL | NATLIHQSITGLYETRIDLSKL-- | 1368 |
| CQR24647 | 1296 | LAQ---SFI | SLLKFTAPGAP-GGFKFLD--ADI--KQSnlR-YQTVTEVL | SSTLIHQSVTGLYETRIDLSQF-- | 1358 |
| WP_000066813 | 1312 | LAN---SFI | NLLTFTAIGAP-AAFKFLG--KDV--DRK-R-YTTVSEIL | NATLIHQSITGLYETRIDLSKL-- | 1372 |
| WP_009754323 | 1308 | LAN---SFI | NLLTFTAIGAP-AAFKFPG--KDI--DRK-R-YTSIAEIL | NATLIHQSITGLYETRIDLSKL-- | 1368 |
| WP_044674937 | 1301 | LTS---SFV | NLLTFTAIGAP-AAFKFLG--SVI--DRK-R-YTSIAEIL | EATLIHQSVTGLYETRIDLSKL-- | 1361 |
| WP_044676715 | 1303 | LTS---SFV | NLLTFTAIGAP-AAFKFLG--SVI--DRK-R-YTSIAEIL | EATLIHQSVTGLYETRIDLSKL-- | 1363 |
| WP_044680361 | 1301 | LTS---SFV | NLLTFTAIGAP-AAFKFLG--SVI--DRK-R-YTSIAEIL | EATLIHQSVTGLYETRIDLSKL-- | 1363 |
| WP_044681799 | 1301 | LTS---SFV | NLLTFTAIGAP-AAFKFLG--AEI--DRK-R-YTSIAEIL | EATLIHQSVTGLYETRIDLSKL-- | 1361 |
| WP_049533112 | 1314 | ICT---SFL | GLPELTSLGSA-SDFEFLG--VKI--PRY--RdYTPSSLLK | DSTLIHQSITGLYETRIDLSKL-- | 1383 |
| WP_029090905 | 1241 | -VK---VI | ELLKITQANATnGDLKLLK--- M-sNREg-R-LGSVSVAL | DFKIINQSVTGLYQSIEDYNN-- | 1300 |
| WP_006506696 | 1269 | -AN---II | QMLIVMHRGPQnGNIVYDDf--KI--sDRig-R-LKTKNHNL | NIVFISQSPTGIYTKKYKL--- | 1329 |
| AIT42264 | 1306 | -AE---NII | HLPFTLTNLGAP-AAFKYFD--TTI--DRK-R-YTSTKEVL | DATLIHQSITGLYETRIDLSQL-- | 1365 |
| WP_034440723 | 1277 | LVE---SFV | NLLAITTKCGPA-ADITFLG--EKI--SRK-R-YRSTNCLW | GSEVIFQSPTGLYETRLRLE--- | 1335 |
| AKQ21048 | 1306 | -AE---NII | HLPFTLTNLGAP-AAFKYFD--TTI--DRK-R-YTSTKEVL | DATLIHQSITGLYETRIDLSQL-- | 1365 |
| WP_004636532 | 1272 | TVE---SFV | NLMTFTAMGAP-ATFKYFG--ESI--TRS-R-YTSITEFR | GSTLIFQSITGLYETRYKL--- | 1329 |
| WP_002636836 | 1278 | IAA---SFI | QLMQFNAMGAP-STFKFFQ--KDI--ERA-R-YTSIKEIF | DATIIYQSPTGLYETRRKV--- | 1335 |
| WP_016631044 | 1229 | IAA---SFI | QLMQFNAMGAP-STFKFFQ--KDI--ERA-R-YTSIKEIF | DATIIYQSPTGLYETRRKV--- | 1286 |
| EMS75795 | 1014 | LSQ---SFI | NLMQLNAMGAP-ADFKFFD--VII--PRK-R-YPSLTEIW | ESTITYQSTTGLRETRTRMATLwd | 1076 |
| WP_002373311 | 1278 | IAA---SFI | QLMQFNAMGAP-STFKFFQ--KDI--ERA-R-YTSIKEIF | DATIIYQSTTGLYETRRKV--- | 1335 |
| WP_002378009 | 1278 | IAA---SFI | QLMQFNAMGAP-STFKFFQ--KDI--ERA-R-YTSIKEIF | DATIIYQSTTGLYETRRKV--- | 1335 |
| WP_002407324 | 1278 | IAA---SFI | QLMQFNAMGAP-STFKFFQ--KDI--ERA-R-YTSIKEIF | DATIIYQSTTGLYETRRKV--- | 1335 |

-continued

| ID | | | | | | | |
|---|---|---|---|---|---|---|---|
| WP_002413717 | 1278 | IAA---SFI | QLMQFNAMGAP-STFKFFQ- | -KDI--ERA- | -R-YTSIKEIF | DATIIYQSTTGLYETRRKV----- | 1335 |
| WP_010775580 | 1280 | IAA---SFI | QLMQFNAMGAP-STFKFFQ- | -KDI--ERA- | -R-YTSIKEIF | DATIIYQSTTGLYETRRKV----- | 1337 |
| WP_010818269 | 1278 | IAA---SFI | QLMQFNAMGAP-STFKFFQ- | -KDI--ERA- | -R-YTSIKEIF | DATIIYQSTTGLYETRRKV----- | 1335 |
| WP_010824395 | 1278 | IAA---SFI | QLMQFNAMGAP-STFKFFQ- | -KDI--ERA- | -R-YTSIKEIF | DATIIYQSTTGLYETRRKV----- | 1335 |
| WP_016622645 | 1278 | IAA---SFI | QLMQFNAMGAP-STFKFFQ- | -KDI--ERA- | -R-YTSIKEIF | DATIIYQSTTGLYETRRKV----- | 1335 |
| WP_033625576 | 1278 | IAA---SFI | QLMQFNAMGAP-STFKFFQ- | -KDI--ERA- | -R-YTSIKEIF | DATIIYQSTTGLYETRRKV----- | 1335 |
| WP_033624816 | 1278 | IAA---SFI | QLMQFNAMGAP-STFKFFQ- | -KDI--ERA- | -R-YTSIKEIF | DATIIYQSTTGLYETRRKV----- | 1335 |
| WP_033789179 | 1278 | IAA---SFI | QLMQFNAMGAP-STFKFFQ- | -KDI--ERA- | -R-YTSIKEIF | DATIIYQSTTGLYETRRKV----- | 1335 |
| WP_002310644 | 1280 | LAS---SFV | NLMQFNAMGAP-ADFKFFD- | -VTI--PRK- | -R-YTSLTEIW | QSTIIHQSITGLYETRIRMGK--- | 1339 |
| WP_002312694 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_002314015 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_002320716 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_002330729 | 1280 | LAS---SFV | NLMQFNAMGAP-ADFKFFD- | -VTI--PRK- | -R-YTSLTEIW | QSTIIHQSITGLYETRIRMGK--- | 1339 |
| WP_002335161 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_002345439 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_034867970 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_047937432 | 1271 | IAQ---SFL | QLLQFNAIGAP-ADFKFFG- | -VTI--PRK- | -R-YTSLTEIW | DATIIYQSVTGLYETRIRMGDLwa | 1333 |
| WP_002310644 | 1281 | LAS---SFV | NLMQFNAMGAP-ADFKFFD- | -VTI--PRK- | -R-YTSLTEIW | QSTIIHQSITGLYETRIRMGK--- | 1340 |
| WP_010720994 | 1271 | IAQ---SFL | QLLQFNAIGAP-ADFKFFG- | -VTI--PRK- | -R-YTSLTEIW | DATIIYQSVTGLYETRIRMGDLwa | 1333 |
| WP_010737004 | 1271 | IAQ---SFL | QLLQFNAIGAP-ADFKFFG- | -VTI--PRK- | -R-YTSLTEIW | DATIIYQSVTGLYETRIRMGDLwa | 1333 |
| WP_034700478 | 1271 | IAQ---SFL | QLLQFNAIGAP-ADFKFFG- | -VTI--PRK- | -R-YTSLTEIW | DATIIYQSVTGLYETRIRMGDLwa | 1333 |
| WP_007209003 | 1270 | IAK---SFI | NLLTFTAMGAP-ADFEFFG- | -EKI--PRK- | -R-YVSISEII | DAVFIHQSITGLYETRVRLTEV- | 1330 |
| WP_023519017 | 1265 | MID---AIL | SLLKFTLFGAS-VEFKFFD- | -IKI--LK-- | -R-YKSLTDIW | EATIIYQSVTGLYERRVEVRKLwd | 1326 |
| WP_010770040 | 1275 | IAE---SFV | NLMKFSAYGAP-MDFKFFG- | -ETI--PRS- | -R-YTSVGELL | SATINQSITGLYETRRKL------ | 1332 |
| WP_048604708 | 1271 | IAQ---SFV | DLMQLNAFGAP-ADFKFFE- | -ETI--BRK- | -R-YTSVNELL | EATINQSITGLYETRRKL------ | 1328 |
| WP_010750235 | 1274 | MAH---SFV | NLMQFNALGAP-ADFKFFD- | -TTI--TRK- | -R-YTSLTEIW | QSTIIYQSVTGLYETRRRMADLwa | 1336 |
| AII16583 | 1345 | -AE---NII | HLFTLTNLGAP-AAFKYFD- | -TTI--DRK- | -R-YTSTKEVL | DATLIHQSITGLYETRIDLSQL- | 1404 |
| WP_029073316 | 1283 | -CE---VI- | QMLVVMHAGPQnGNITFDDf- | -KL--sNRlg | -R-LNCKTISL | TTVFIADSPTGMYSKKYKL---- | 1343 |
| WP_031589969 | 1284 | -CN---II- | QILATLHCNSSiGKIMYSDf- | -KLI-sTTIg | -R-LNGRTISL | DISFIAESPTGMYSKKYKL---- | 1344 |
| KDA45870 | 1254 | LGK---NFV | ELLRYTADGAA-SDFKFFG- | -ENI--PRK- | -R-YNSAGSLL | NGTLIYQSKTGLYETRIDLGKL- | 1314 |
| WP_039099354 | 1307 | ILDr---V- | -LIGLHANAAV-SDLGVLKisTPL- | -GKM--Q-- | ---QPSGIS | DTQIIYQSPTGLFERRVALRDL- | 1368 |
| AKP02966 | 1297 | INS1-eELI | TLLHANSTSAH-LIFNNIE-kKAP- | -GRK----- | ------THGLT | DTDFIYQSVTGLYETRIHIE--- | 1356 |
| WP_010991369 | 1275 | IAQ---SFV | DLMAFNAMGAP-ASFKFFE- | -TTI--ERK- | -R-YNNLKELL | NSTIIYQSITGLYESRKRL---- | 1332 |
| WP_033838504 | 1275 | IAQ---SFV | DLMAFNAMGAP-ASFKFFE- | -TTI--ERK- | -R-YNNLKELL | NSTIIYQSITGLYESRKRL---- | 1332 |
| EHN60060 | 1278 | IAQ---SFV | DLMAFNAMGAP-ASFKFFE- | -TTI--ERK- | -R-YNNLKELL | SATIIYQSITGLYEARKRL---- | 1335 |
| EFR89594 | 1044 | IAQ---SFV | DLMAFNAMGAP-ASFKFFE- | -TTI--ERK- | -R-YNNLKELL | NSTIIYQSITGLYESRKRL---- | 1101 |
| WP_038409211 | 1275 | IAK---SFD | KLKVFNAFGAP-RDFEFFE- | -TTI--KRK- | -R-YYNIKELL | NATIIYQSITGLYEARKRL---- | 1332 |
| EFR95520 | 894 | IAK---SFD | KLKVFNAFGAP-KDFNFFG- | -TTI--KRK- | -R-YYNIKELL | NATIIYQSITGLYEARKRL---- | 951 |
| WP_003723650 | 1275 | IAQ---SFV | DLMAFNAMGAP-ASFKFFE- | -ATI--DRK- | -R-YTNLKELL | SSTIIYQSITGLYESRKRL---- | 1332 |
| WP_003727705 | 1275 | IAQ---SFV | DLMAFNAMGAP-ASFKFFE- | -ATI--DRK- | -R-YTNLKELL | SSTIIYQSITGLYESRKRL---- | 1332 |
| WP_003730785 | 1275 | IAQ---SFV | DLMAFNAMGAP-ASFKFFE- | -ATI--DRK- | -R-YTNLKELL | SSTIIYQSITGLYESRKRL---- | 1332 |
| WP_003733029 | 1275 | IAE---SFV | DLMAFNAMGAP-ASFKFFE- | -TKI--DRK- | -R-YTNLKELL | NSTIIYQSITGLYESRKRL---- | 1332 |
| WP_003739838 | 1278 | IAQ---SFV | NLMAFNAMGAP-ASFKFFE- | -ATI--DRK- | -R-YTNLKELL | SATIIYQSITGLYEARKRL---- | 1335 |
| WP_014601172 | 1275 | IAQ---SFV | DLMAFNAMGAP-ASFKFFE- | -TTI--DRK- | -R-YTNLKELL | SSTIIYQSITGLYESRKRL---- | 1332 |
| WP_023548323 | 1275 | IAE---SFV | DLMAFNAMGAP-ASFKFFE- | -TTI--KRK- | -R-YTNLKELL | SSTIIYQSITGLYESRKRL---- | 1332 |
| WP_031665337 | 1275 | IAQ---SFV | DLMAFNAMGAP-ASFKFFE- | -ATI--DRK- | -R-YTNLKELL | SSTIIYQSITGLYESRKRL---- | 1332 |
| WP_031669209 | 1275 | IAQ---SFV | DLMAFNAMGAP-ASFKFFE- | -TKI--DRK- | -R-YTNLKELL | SSTIIYQSITGLYESRKRL---- | 1332 |
| WP_033920898 | 1275 | IAE---SFV | SLKKFNAFGVH-QDFSFFG- | -TTI--KRK- | -R-DRKLNELL | NSTIIYQSITGLYESRKRL---- | 1332 |
| AKI42028 | 1278 | IAE---SFV | SLKKFNAFGVH-KDFSFFG- | -ATI--ERK- | -R-YTNLKELL | SATIIYQSITGLYEARKRL---- | 1335 |
| AKI50529 | 723 | IAE---SFV | SLKKFNAFGVH-KDFNFFG- | -TTI--KRK- | -R-DRKLKELL | SSTIIYQSITGLYESRKRL---- | 780 |
| EFR83390 | 1275 | IAQ---SFV | SLKKFNAFGVH-QDFSFFG- | -TKI--ERK- | -R-DRKLNELL | NSTIIYQSITGLYESRKRL---- | 1332 |
| WP_046323366 | 1278 | IAQ---SFV | DLMVFNAMGAP-ASFKYFE- | -TNI--DRK- | -R-YTNLKELL | NATIIYQSITGLYEARKRL---- | 1335 |
| AKE81011 | 1322 | -AE---NII | HLFTLTNLGAP-AAFKYFD- | -TTI--DRK- | -R-YTSTKEVL | DATLIHQSITGLYETRIDLSQL- | 1381 |
| CU082355 | 1273 | -AN---VI- | QMLIIMHKGPQnGNIIYDDf- | -NV-gKRig | -R-LNGRFFYL | NIEFISQSPTGIYTKKYL----- | 1333 |

```
WP_033162887    1275  -CD-----VI QLLIMHAGPMnGNIMYDDf--KF-tNRIg-R-FTHKNIDL KTTFISTSVTGLFSKKYKL----     1335
AGZ01981        1339  -AE----NII HLFTLTNLGAP-AAFKYFD--TTI--DRK--R-YTSTKEVL DATLIHQSITGLYETRIDLSQL--     1398
AKA60242        1306  -AE----NII HLFTLTNLGAP-AAFKYFD--TTI--DRK--R-YTSTKEVL DATLIHQSITGLYETRIDLSQL--     1365
AKS40380        1306  -AE----NII HLFTLTNLGAP-AAFKYFD--TTI--DRK--R-YTSTKEVL DATLIHQSITGLYETRIDLSQL--     1365
4UN5_B          1310  -AE----NII HLFTLTNLGAP-AAFKYFD--TTI--DRK--R-YTSTKEVL DATLIHQSITGLYETRIDLSQL--     1369

WP_010922251    1366  GGD                                                                           1368
WP_010922251    1370  GEE                                                                           1372
WP_039695303    1368  GED                                                                           1370
WP_045635197    ---                                                                                 
5AXW_A          1050  GGD                                                                           1052
WP_009880683    1366  GGD                                                                           1368
WP_010922251    1366  GGD                                                                           1368
WP_011054416    1366  GGD                                                                           1368
WP_011284745    1366  GGD                                                                           1368
WP_011285506    1366  GGD                                                                           1368
WP_011527619    1365  GGD                                                                           1367
WP_012560673    1365  GGD                                                                           1367
WP_014407541    1365  GGD                                                                           1367
WP_020905136    1366  GGD                                                                           1368
WP_023080005    1366  GGD                                                                           1368
WP_023610282    1366  GGD                                                                           1368
WP_030125963    1366  GGD                                                                           1368
WP_030126706    1366  GGD                                                                           1368
WP_031488318    1366  GGD                                                                           1368
WP_032460140    1366  GGD                                                                           1368
WP_032461047    1366  GGD                                                                           1368
WP_032462016    1366  GGD                                                                           1368
WP_032462936    1366  GGD                                                                           1368
WP_032464890    1366  GGD                                                                           1368
WP_033888930    1191  GGD                                                                           1193
WP_038431314    1366  GGD                                                                           1368
WP_038432938    1365  GGD                                                                           1367
WP_038434062    1366  GGD                                                                           1368
BAQ51233        1277  GGD                                                                           1279
KGE60162         541  GGD                                                                            543
KGE60856         304  GGD                                                                            306
WP_002989955    1366  GGD                                                                           1368
WP_003030002    1343  GED                                                                           1345
WP_003065552    1371  GEE                                                                           1373
WP_001040076    1368  GED                                                                           1370
WP_001040078    1376  GED                                                                           1378
WP_001040080    1368  GED                                                                           1370
WP_001040081    1368  GED                                                                           1370
WP_001040083    1368  GED                                                                           1370
WP_001040085    1368  GED                                                                           1370
WP_001040087    1368  GED                                                                           1370
WP_001040088    1368  GED                                                                           1370
WP_001040089    1368  GED                                                                           1370
WP_001040090    1368  GED                                                                           1370
WP_001040091    1368  GED                                                                           1370
WP_001040092    1368  GED                                                                           1370
WP_001040094    1368  GED                                                                           1370
WP_001040095    1368  GEG                                                                           1370
```

-continued

| | | | |
|---|---|---|---|
| WP_001040096 | 1368 | GEG | 1370 |
| WP_001040097 | 1368 | GED | 1370 |
| WP_001040098 | 1368 | GED | 1370 |
| WP_001040099 | 1368 | GED | 1370 |
| WP_001040100 | 1368 | GED | 1370 |
| WP_001040104 | 1368 | GED | 1370 |
| WP_001040105 | 1368 | GED | 1370 |
| WP_001040106 | 1368 | GED | 1370 |
| WP_001040107 | 1368 | GED | 1370 |
| WP_001040108 | 1368 | GED | 1370 |
| WP_001040109 | 1368 | GED | 1370 |
| WP_001040110 | 1368 | GED | 1370 |
| WP_015058523 | 1368 | GED | 1370 |
| WP_017643650 | 1368 | GED | 1370 |
| WP_017647151 | 1368 | GED | 1370 |
| WP_017648376 | 1368 | GED | 1370 |
| WP_017649527 | 1368 | GED | 1370 |
| WP_017771611 | 1368 | GED | 1370 |
| WP_017771984 | 1368 | GED | 1370 |
| CFQ25032 | 1368 | GED | 1370 |
| CFV16040 | 1368 | GED | 1370 |
| KLJ37842 | 1368 | GGD | 1370 |
| KLJ72361 | 1382 | GED | 1384 |
| KLL20707 | 1368 | GED | 1370 |
| KLL42645 | 1368 | GED | 1370 |
| WP_047207273 | 1368 | GED | 1370 |
| WP_047209694 | 1368 | GED | 1370 |
| WP_050198062 | 1368 | GED | 1370 |
| WP_050201642 | 1368 | GED | 1370 |
| WP_050204027 | 1368 | GED | 1370 |
| WP_050881965 | 1368 | GED | 1370 |
| WP_050886065 | 1368 | GED | 1370 |
| AHN30376 | 1368 | GED | 1370 |
| EA078426 | 1368 | GED | 1370 |
| CCW42055 | 1384 | GED | 1386 |
| WP_003041502 | 1344 | GED | 1346 |
| WP_037593752 | 1344 | GED | 1346 |
| WP_049516684 | 1343 | GED | 1345 |
| GAD46167 | 1375 | GEE | 1377 |
| WP_018363470 | 1373 | GEE | 1375 |
| WP_003043819 | 1343 | GED | 1345 |
| WP_006269658 | 1363 | GED | 1365 |
| WP_048800889 | 1369 | GGD | 1371 |
| WP_012767106 | 1369 | GED | 1371 |
| WP_014612333 | 1369 | GGD | 1371 |
| WP_015017095 | 1369 | GGD | 1371 |
| WP_015057649 | 1369 | GGD | 1371 |
| WP_048272215 | 1369 | GGD | 1371 |
| WP_049519324 | 1346 | GEN | 1348 |
| WP_012515931 | 1346 | GEN | 1348 |
| WP_021320964 | 1346 | GEN | 1348 |
| WP_037581760 | 1375 | GEE | 1377 |
| WP_004232481 | | | |

-continued

| | | |
|---|---|---|
| WP_009854540 | 1368 GEE | 1370 |
| WP_012962174 | 1369 GEE | 1371 |
| WP_039695303 | 1370 GEE | 1372 |
| WP_014334983 | 1373 GEE | 1375 |
| WP_003099269 | 1366 GGK | 1368 |
| AHY15608 | - - | |
| AHY17476 | - - | |
| ESR09100 | 198 GGK | 200 |
| AGM98575 | - - | |
| ALF27331 | 1343 GGD | 1345 |
| WP_018372492 | 1351 GEN | 1353 |
| WP_045618028 | 1374 GED | 1376 |
| WP_045635197 | 1368 GGD | 1370 |
| WP_002263549 | 1343 GGD | 1345 |
| WP_002263887 | 1343 GGD | 1345 |
| WP_002264920 | 1343 GGD | 1345 |
| WP_002269043 | 1343 GGD | 1345 |
| WP_002269448 | 1343 GGD | 1345 |
| WP_002271977 | 1343 GGD | 1345 |
| WP_002272766 | 1343 GGD | 1345 |
| WP_002273241 | 1343 GGD | 1345 |
| WP_002275430 | 1343 GGD | 1345 |
| WP_002276448 | 1343 GGD | 1345 |
| WP_002277050 | 1353 GGD | 1355 |
| WP_002277364 | 1343 GGD | 1345 |
| WP_002279025 | 1343 GGD | 1345 |
| WP_002279859 | 1343 GGD | 1345 |
| WP_002280230 | 1343 GGD | 1345 |
| WP_002281696 | 1343 GGD | 1345 |
| WP_002282247 | 1353 GGD | 1355 |
| WP_002282906 | 1343 GGD | 1345 |
| WP_002283846 | 1343 GGD | 1345 |
| WP_002287255 | 1343 GGD | 1345 |
| WP_002288990 | 1343 GGD | 1345 |
| WP_002289641 | 1343 GGD | 1345 |
| WP_002290427 | 1343 GGD | 1345 |
| WP_002295753 | 1343 GGD | 1345 |
| WP_002296423 | 1343 GGD | 1345 |
| WP_002304487 | 1357 GGD | 1359 |
| WP_002305844 | 1343 GGD | 1345 |
| WP_002307203 | 1343 GGD | 1345 |
| WP_002310390 | 1343 GGD | 1345 |
| WP_002352408 | 1343 GGD | 1345 |
| WP_012997688 | 1343 GGD | 1345 |
| WP_014677909 | 1343 GGD | 1345 |
| WP_019312892 | 1343 GGD | 1345 |
| WP_019313659 | 1343 GGD | 1345 |
| WP_019314093 | 1343 GGD | 1345 |
| WP_019315370 | 1343 GGD | 1345 |
| WP_019803776 | 1343 GGD | 1345 |
| WP_019805234 | 1343 GGD | 1345 |
| WP_024783594 | 1343 GGD | 1345 |
| WP_024784288 | 1353 GGD | 1355 |

-continued

| | | | |
|---|---|---|---|
| WP_024784666 | 1343 | GGD | 1345 |
| WP_024784894 | 1343 | GGD | 1345 |
| WP_024786433 | 1353 | GGD | 1355 |
| WP_049473442 | 1343 | GGD | 1345 |
| WP_049474547 | 1343 | GGD | 1345 |
| EMC03581 | 1336 | GGD | 1338 |
| WP_000428612 | 1371 | GED | 1373 |
| WP_000428613 | 1369 | GED | 1371 |
| WP_049523028 | 1364 | GEE | 1366 |
| WP_003107102 | 1335 | GGD | 1337 |
| WP_054279288 | 1366 | GGD | 1368 |
| WP_049531101 | 1374 | GED | 1376 |
| WP_049538452 | 1374 | GED | 1376 |
| WP_049549711 | 1376 | GED | 1378 |
| WP_007896501 | 1372 | GED | 1374 |
| EFR44625 | 1324 | GGD | 1326 |
| WP_002897477 | 1368 | GEE | 1370 |
| WP_002906454 | 1375 | GED | 1377 |
| WP_009729476 | 1369 | GED | 1371 |
| CQR24647 | 1359 | GGE | 1361 |
| WP_000066813 | 1373 | GED | 1375 |
| WP_009754323 | 1369 | GED | 1371 |
| WP_044674937 | 1362 | GGD | 1364 |
| WP_044676715 | 1364 | GGD | 1366 |
| WP_044680361 | 1362 | GGD | 1364 |
| WP_044681799 | 1362 | GGD | 1364 |
| WP_049533112 | 1384 | GED | 1386 |
| WP_029090905 | | - - | |
| WP_006506696 | | - - | |
| A1T42264 | 1366 | GGD | 1389 |
| WP_034440723 | | | |
| AKQ21048 | 1366 | GGD | 1384 |
| WP_004636532 | 1330 | -ED | 1332 |
| WP_002364836 | 1336 | -VD | 1337 |
| WP_016631044 | 1287 | -VD | 1288 |
| EMS75795 | 1077 | GEQ | 1079 |
| WP_002373311 | 1336 | -VD | 1337 |
| WP_002378009 | 1336 | -VD | 1337 |
| WP_002407324 | 1336 | -VD | 1337 |
| WP_002413717 | 1338 | -VD | 1339 |
| WP_010775580 | 1336 | -VD | 1337 |
| WP_010818269 | 1336 | -VD | 1337 |
| WP_010824395 | 1336 | -VD | 1337 |
| WP_016622645 | 1336 | -VD | 1337 |
| WP_033624816 | 1336 | -VD | 1337 |
| WP_033789179 | 1336 | -VD | 1337 |
| WP_002310644 | | - - | |
| WP_002312694 | | - - | |
| WP_002314015 | | - - | |
| WP_002320716 | | - - | |
| WP_002330729 | | - - | |
| WP_002335161 | | - - | |

-continued

| ID | | | | |
|---|---|---|---|---|
| WP_002345439 | | | | |
| WP_034867970 | | | | |
| WP_047937432 | | | | |
| WP_010720994 | 1334 | --- | 1334 | --- |
| WP_010737004 | 1334 | GEQ | 1336 | GEQ |
| WP_034700478 | 1334 | GEQ | 1336 | GEQ |
| WP_007209003 | 1334 | GEQ | 1336 | GEQ |
| WP_023519017 | 1327 | GER | 1330 | |
| WP_010770040 | 1333 | -VD | 1334 | |
| WP_048604708 | 1329 | -GD | 1330 | |
| WP_010750235 | 1337 | GVQ | 1339 | |
| AII16583 | 1405 | GGD | 1424 | |
| WP_029073316 | | | | |
| WP_031589969 | | | | |
| KDA45870 | | | | |
| WP_039099354 | | | | |
| AKP02966 | | | | |
| WP_010991369 | 1333 | -DD | 1334 | |
| WP_033838504 | 1333 | -DD | 1334 | |
| EHN60060 | 1336 | -DD | 1337 | |
| EFR89594 | 1102 | -DD | 1103 | |
| WP_038409211 | 1333 | -ED | 1334 | |
| EFR95520 | 952 | -ED | 953 | |
| WP_003723650 | 1333 | -DD | 1334 | |
| WP_003727705 | 1333 | -DD | 1334 | |
| WP_003730785 | 1333 | -DD | 1334 | |
| WP_003733029 | 1333 | -DN | 1334 | |
| WP_003739838 | 1333 | -DG | 1334 | |
| WP_014601172 | 1333 | -DD | 1334 | |
| WP_023548323 | 1333 | -DS | 1334 | |
| WP_031665337 | 1333 | -DD | 1334 | |
| WP_031669209 | 1333 | -DN | 1334 | |
| WP_033920898 | 1333 | -DS | 1334 | |
| AKI42028 | 1336 | -DD | 1337 | |
| AKI50529 | 1336 | -DS | 1337 | |
| EFR83390 | 781 | -DD | 782 | |
| WP_046323366 | 1333 | -DD | 1334 | |
| AKE81011 | 1382 | GGD | 1400 | |
| CUO82355 | | | | |
| WP_033162887 | | | | |
| AGZ01981 | 1399 | GGD | 1417 | |
| AKA60242 | 1366 | GGD | 1368 | |
| AKS40380 | 1366 | GGD | 1376 | |
| 4UN5_B | 1370 | GGD | 1372 | |

TABLE 2

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000071.2 (CBS):c.833T>C (p.Ile278Thr) | 875 | CBS | 2540 | ['CTGAAGCCGC GCCCTCTGCAG ATCAYTGGGGT GGATCCCGAA GGGTCCATC'] | 2703-2704 | ['ATCAYTGGGGTG GATCCCGAAGG', 'TCAYTGGGGTGGA TCCCGAAGGG'] | 2907-2908 | ['ATCAYTGGGGTG GATCCCGAAGG', 'TCAYTGGGGTGG ATCCCGAAGGG'] |
| NM_001385.2 (DPYS):c.1078T>C (p.Trp360Arg) | 1807 | DPYS | 2541 | ['TGTTGAAGAT CGGATGTCCGT AATAYGGGAA AAAGGCGTGG TGGGTTTCAC'] | 2705-2707 | ['CGTAATAYGGGA AAAAGGCGTGG', 'AATAYGGGAAAA AGGCGTGGTGG', 'ATAYGGGAAAAA GGCGTGGTGGG'] | 2909-2911 | ['CGTAATAYGGGA AAAAGGCGTGG', 'AATAYGGGAAAA AGGCGTGGTGG', 'ATAYGGGAAAAA GGCGTGGTGGG'] |
| NM_000027.3 (AGA):c.916T>C (p.Cys306Arg) | 175 | AGA | 2542 | ['TCCAGAATTC TTTGGGGCTGT TATAYGTGCCA ATGTGACTGGA AGTTACGG'] | 2708 | ['GTTATAYGTGCC AATGTGACTGG'] | 2912 | ['GTTATAYGTGCC AATGTGACTGG'] |
| NM_000035.3 (ALDOB):c.442T>C (p.Trp148Arg) | 229 | ALDOB | 2543 | ['GAAAGATGGT GTTGACTTTGG GAAGYGGCGT GCTGTGCTGAG GATTGCCGA'] | 2709 | ['GGAAGYGGCGTG CTGTGCTGAGG'] | 2913 | ['GGAAGYGGCGT GCTGTGCTGAGG'] |
| NM_173560.3 (RFX6):c.380+2T>C | 222546 | RFX6 | 2544 | ['GCAGACACAG CTCACGCTGCA GTGGYGAGAC TCGCCCGCAGG GTACACTGA'] | 2710-2711 | ['CAGTGGYGAGAC TCGCCCGCAGG', 'AGTGGYGAGACTC GCCCGCAGGG'] | 2914-2915 | ['CAGTGGYGAGAC TCGCCCGCAGG', 'AGTGGYGAGACT CGCCCGCAGGG'] |
| NM_153704.5 (TMEM67):c.1843T>C (p.Cys615Arg) | 91147 | TMEM67 | 2545 | ['AGAACGTTTT GTCACTTATGT TGGAHGTGCCT TTGCTCTGAAG GTAAGTTT'] | 2712 | ['TGGAHGTGCCTTT GCTCTGAAGG'] | 2916 | ['TGGAHGTGCCTT TGCTCTGAAGG'] |
| NM_000124.3 (ERCC6):c.2960T>C (p.Leu987Pro) | 2074 | ERCC6 | 2546 | ['AAGCAGTTTT TGACAAATAG AGTGCYAAAA GACCCAAAAC AAAGGCGGTTT'] | 2713 | ['TGCYAAAAGACC CAAAACAAAGG'] | 2917 | ['TGCYAAAAGACC CAAAACAAAGG'] |
| NM_020435.3 (GJC2):c.857T>C (p.Met286Thr) | 57165 | GJC2 | 2547 | ['TGCCTGCTGC TCAACCTCTGT GAGAYGGCCC ACCTGGGCTTG GGCAGCGCG'] | 2714 | ['TGAGAYGGCCCA CCTGGGCTTGG'] | 2918-2919 | ['TGAGAYGGCCCA CCTGGGCTTGG', 'GAGAYGGCCCAC CTGGGCTTGGG'] |
| NM_000920.3 (PC):c.434T>C (p.Val145Ala) | 5091 | PC | 2548 | ['CGGTTTATTG GGCCAAGCCC AGAAGBGGTC CGCAAGATGG GAGACAAGGTG'] | 2715 | ['CCAGAAGBGGTC CGCAAGATGGG'] | 2920 | ['CCAGAAGBGGTC CGCAAGATGGG'] |
| NM_000026.2 (ADSL):c.674T>C (p.Met225Thr) | 158 | ADSL | 2549 | ['TCCAAGGTAG AGCAGCTTGAC AAGAYGGTGA CAGAAAAGGC AGGATTTAAG'] | 2716 | ['AAGAYGGTGACA GAAAAGGCAGG'] | 2921 | ['AAGAYGGTGAC AGAAAAGGCAGG'] |
| NM_000391.3 (TPP1):c.1093T>C (p.Cys365Arg) | 1200 | TPP1 | 2550 | ['TCTCTCAGGT GACAGTGGGG CCGGGYGTTG GTCTGTCTCTG GAAGACACCA'] | 2717 | ['GCCGGGYGTTGG TCTGTCTCTGG'] | 2922 | ['GCCGGGYGTTGG TCTGTCTCTGG'] |
| NM_004183.3 (BEST1):c.704T>C (p.Val235Ala) | 7439 | BEST1 | 2551 | ['TACGACTGGA TTAGTATCCCA CTGGYGTATAC ACAGGTGAGG ACTAGGCTG'] | 2718 | ['CACTGGYGTATA CACAGGTGAGG'] | 2923 | ['CACTGGYGTATA CACAGGTGAGG'] |
| NM_000019.3 (ACAT1):c.935T>C (p.Ile312Thr) | 38 | ACAT1 | 2552 | ['CTCAATGTTA CACCACTGGCA AGAAYAGTAG GTAAGGCCAG GCGAGGTGGC'] | 2719 | ['CAAGAAYAGTAG GTAAGGCCAGG'] | 2924 | ['CAAGAAYAGTA GGTAAGGCCAGG'] |

TABLE 2-continued

T to C changes with NGG PAM. Table 2 shows a list of T to C mutations that may
be corrected using any of the base editors provided herein. GRNAs and gRNAall indicate the
protospacer and PAM sequence, where the PAM sequence is the last 3 nucleotides of each of
the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000543.4 (SMPD1):c.911T>C (p.Leu304Pro) | 6609 | SMPD1 | 2553 | ['CGGGCCCTGA CCACCGTCACA GCACYTGTGA GGAAGTTCCTG GGGCCAGTG'] | 2720 | ['CACYTGTGAGGA AGTTCCTGGGG'] | 2925-2927 | ['AGCACYTGTGAG GAAGTTCCTGG', 'GCACYTGTGAGG AAGTTCCTGGG', 'CACYTGTGAGGA AGTTCCTGGGG'] |
| NM_000527.4 (LDLR):c.694+2T>C | 3949 | LDLR | 2554 | ['ACAAATCTGA CGAGGAAAAC TGCGGYATGG GCGGGGCCAG GGTGGGGGCGG'] | 2721 | ['CGGYATGGGCGG GGCCAGGGTGG'] | 2928-2930 | ['ACTGCGGYATGG GCGGGGCCAGG', 'CTGCGGYATGGG CGGGGCCAGGG', 'CGGYATGGGCGG GGCCAGGGTGG'] |
| NM_012464.4 (TLL1):c.713T>C (p.Val238Ala) | 7092 | TLL1 | 2555 | ['AAGAACTGTG ATAAATTTGGG ATTGYTGTTCA TGAATTGGGTC ATGTGATA'] | 2722 | ['GGGATTGYTGTTC ATGAATTGGG'] | 2931 | ['GGGATTGYTGTT CATGAATTGGG'] |
| NM_000112.3 (SLC26A2):c.-26+2T>C | 1836 | SLC26A2 | 2556 | ['CCTGCAGCGG CCCGGACCCG AGAGGYGAGA AGAGGGAAGC GGACCAGGGA A'] | 2723 | ['GAGAGGYGAGAA GAGGGAAGCGG'] | 2932 | ['GAGAGGYGAGA AGAGGGAAGCGG'] |
| NM_001005741.2 (GBA):c.751T>C (p.Tyr251His) | 2629 | GBA | 2557 | ['CATCTACCAC CAGACCTGGG CCAGAYACTTT GTGAAGTAAG GGATCAGCAA'] | 2724 | ['GCCAGAYACTTT GTGAAGTAAGG'] | 2933-2934 | ['GCCAGAYACTTT GTGAAGTAAGG', 'CCAGAYACTTTGT GAAGTAAGGG'] |
| NM_020365.4 (EIF2B3):c.1037T>C (p.Ile346Thr) | 8891 | EIF2B3 | 2558 | ['CCACCAGTCC ATTCGTCAGCC CAGAYTGTCA GCAAACACCT GGTAAGTGCT'] | 2725 | ['CCAGAYTGTCAG CAAACACCTGG'] | 2935 | ['CCAGAYTGTCAG CAAACACCTGG'] |
| NM_022041.3 (GAN):c.1268T>C (p.Ile423Thr) | 8139 | GAN | 2559 | ['TGCTATGCAG CTATGAAAAA GAAAAAYCTAC GCCATGGGTG GAGGCTCCTAC'] | 2726 | ['AAGAAAAYCTAC GCCATGGGTGG'] | 2936-2937 | ['AAGAAAAYCTAC GCCATGGGTGG', 'AAAAYCTACGCC ATGGGTGGAGG'] |
| NM_054027.4 (ANKH):c.143T>C (p.Met48Thr) | 56172 | ANKH | 2560 | ['GCTGTCAAGG AGGATGCAGT CGAGAYGCTG GCCAGCTACG GGCTGGCGTAC'] | 2727-2728 | ['GTCGAGAYGCTG GCCAGCTACGG', 'TCGAGAYGCTGGC CAGCTACGGG'] | 2938-2939 | ['GTCGAGAYGCTG GCCAGCTACGG', 'TCGAGAYGCTGG CCAGCTACGGG'] |
| NM_006329.3 (FBLN5):c.506T>C (p.Ile169Thr) | 10516 | FBLN5 | 2561 | ['TTGCTTGCAT TTCTGTTTCCA GACAYTGATG AATGTCGCTAT GGTTACTGC'] | 2729 | ['GACAYTGATGAA TGTCGCTATGG'] | 2940 | ['GACAYTGATGAA TGTCGCTATGG'] |
| NM_004086.2 (COCH):c.1535T>C (p.Met512Thr) | −1 | — | 2562 | ['GCACCTCTGG ATGACCTGAA AGATAYGGCTT CTAAACCGAA GGAGTCTCAT'] | 2730 | ['AGATAYGGCTTC TAAACCGAAGG'] | 2941 | ['AGATAYGGCTTC TAAACCGAAGG'] |
| NM_002942.4 (ROBO2):c.2834T>C (p.Ile945Thr) | 6092 | ROBO2 | 2563 | ['AATAGCAACA GTGGCCCAAAT GAGAYTGGAA ATTTTGGCCGT GGAGGTAAG'] | 2731 | ['GAGAYTGGAAAT TTTGGCCGTGG'] | 2942 | ['GAGAYTGGAAAT TTTGGCCGTGG'] |
| NM_001300.5 (KLF6):c.190T>C (p.Trp64Arg) | 1316 | KLF6 | 2564 | ['CAAATTTGAC AGCCAGGAAG ATCTGYGGACC AAAATCATTCT GGCTCGGGA'] | 2732 | ['TCTGYGGACCAA AATCATTCTGG'] | 2943 | ['TCTGYGGACCAA AATCATTCTGG'] |
| NM_030653.3 (DDX11):c.2271+2T>C | 1663 | DDX11 | 2565 | ['CTGGCATATT CCAGGTGCATC CAGGYGCGGG CGTCATGCTGG GCTTGGGTC'] | 2733 | ['TCCAGGYGCGGG CGTCATGCTGG'] | 2944-2945 | ['TCCAGGYGCGGG CGTCATGCTGG', 'CCAGGYGCGGGC GTCATGCTGGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_001451.2 (FOXF1):c.1138T>C (p.Ter380Arg) | 2294 | FOXF1 | 2566 | ['CCAAGACATC AAGCCTTGCGT GATGYGAGGC TGCCGCCGCAG GCCCTCCTG'] | 2734 | ['TGATGYGAGGCT GCCGCCGCAGG'] | 2946 | ['TGATGYGAGGCT GCCGCCGCAGG'] |
| NM_000435.2 (NOTCH3):c.1363T>C (p.Cys455Arg) | 4854 | NOTCH3 | 2567 | ['CCTCGACCGC ATAGGCCAGTT CACCYGTATCT GTATGGCAGGT GGGTGGTG'] | 2735 | ['ACCYGTATCTGTA TGGCAGGTGG'] | 294-72948 | ['TTCACCYGTATC TGTATGGCAGG', 'ACCYGTATCTGTA TGGCAGGTGG'] |
| NM_002427.3 (MMP13):c.272T>C (p.Met91Thr) | 4322 | MMP13 | 2568 | ['CTTGACGATA ACACCTTAGAT GTCAYGAAAA AGCCAAGATG CGGGGTTCCT'] | 2736-2737 | ['GTCAYGAAAAAG CCAAGATGCGG', 'TCAYGAAAAAGCC AAGATGCGGG'] | 2949-2950 | ['GTCAYGAAAAA GCCAAGATGCGG', 'TCAYGAAAAAGC CAAGATGCGGG'] |
| NM_000211.4 (ITGB2):c.446T>C (p.Leu149Pro) | 3689 | ITGB2 | 2569 | ['GATGACCTCA GGAATGTCAA GAAGCYAGGT GGCGACCTGCT CCGGGCCCTC'] | 2738 | ['AGCYAGGTGGCG ACCTGCTCCGG'] | 2951 | ['AGCYAGGTGGCG ACCTGCTCCGG'] |
| NM_005502.3 (ABCA1):c.4429T>C (p.Cys1477Arg) | 19 | ABCA1 | 2570 | ['CAAAATCAAG AAGATGCTGCC TGTGYGTCCCC CAGGGGCAGG GGGGCTGCC'] | 2739-2740 | ['CCTGTGYGTCCCC CAGGGGCAGG', 'CTGTGYGTCCCCC AGGGGCAGGG'] | 2952-2955 | ['CCTGTGYGTCCC CCAGGGGCAGG', 'CTGTGYGTCCCCC AGGGGCAGGG', 'TGTGYGTCCCCCA GGGGCAGGGG', 'GTGYGTCCCCCA GGGGCAGGGG'] |
| m.12297T>C | 4568 | MT-TL2 | 2571 | ['AAAGGATAAC AGCTATCCATT GGTCYTAGGCC CCAAAAATTTT GGTGCAAC'] | 2741 | ['GTCYTAGGCCCC AAAAATTTTGG'] | 2956 | ['GTCYTAGGCCCC AAAAATTTTGG'] |
| m.4290T>C | 4565 | MT-TI | 2572 | ['AAATATGTCT GATAAAAGAG TTACTYTGATA GAGTAAATAA TAGGAGCTTA'] | 2742 | ['ACTYTGATAGAG TAAATAATAGG'] | 2957 | ['ACTYTGATAGAG TAAATAATAGG'] |
| m.4291T>C | 4565 | MT-TI | 2573 | ['AATATGTCTG ATAAAAGAGT TACTTYGATAG AGTAAATAAT AGGAGCTTAA'] | 2743 | ['ACTTYGATAGAG TAAATAATAGG'] | 2958 | ['ACTTYGATAGAG TAAATAATAGG'] |
| m.3394T>C | 4535 | MT-ND1 | 2574 | ['GCTTACCGAA CGAAAAATTCT AGGCYATATA CAACTACGCA AAGGCCCCAA'] | 2744 | ['GGCYATATACAA CTACGCAAAGG'] | 2959 | ['GGCYATATACAA CTACGCAAAGG'] |
| NM_002764.3 (PRPS1):c.344T>C (p.Met115Thr) | 5631 | PRPS1 | 2575 | ['ATCTCAGCCA AGCTTGTTGCA AATAYGCTATC TGTAGCAGGTG CAGATCAT'] | 2745 | ['GCAAATAYGCTA TCTGTAGCAGG'] | 2960 | ['GCAAATAYGCTA TCTGTAGCAGG'] |
| NM_000132.3 (F8):c.5372T>C (p.Met1791Thr) | 2157 | F8 | 2576 | ['AGAGCAGAA GTTGAAGATA ATATCAYGGTG AGTTAAGGAC AGTGGAATTAC'] | 2746 | ['TCAYGGTGAGTT AAGGACAGTGG'] | 2961 | ['TCAYGGTGAGTT AAGGACAGTGG'] |
| NM_000132.3 (F8):c.1754T>C (p.Ile585Thr) | 2157 | F8 | 2577 | ['CCTTTCAATA TATGTAATTAA CAGAYAATGT CAGACAAGAG GAATGTCATC'] | 2747 | ['AACAGAYAATGT CAGACAAGAGG'] | 2962 | ['AACAGAYAATGT CAGACAAGAGG'] |
| NM_000133.3 (F9):c.1328T>C (p.Ile443Thr) | 2158 | F9 | 2578 | ['TGTGCAATGA AAGGCAAATA TGGAAYATAT ACCAAGGTATC CCGGTATGTC'] | 2748 | ['GAAYATATACCA AGGTATCCCGG'] | 2963 | ['GAAYATATACCA AGGTATCCCGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000169.2 (GLA):c.806T>C (p.Val269Ala) | −1 | — | 2579 | ['TTATTTCATTC TTTTTCTCAGT TAGYGATTGGC AACTTTGGCCT CAGCTGG'] | 2749 | ['CAGTTAGYGATT GGCAACTTTGG'] | 2964 | ['CAGTTAGYGATT GGCAACTTTGG'] |
| NM_000116.4 (TAZ):c.352T>C (p.Cys118Arg) | 6901 | TAZ | 2580 | ['CTCCCACTTC TTCAGCTTGGG CAAGYGTGTG CCTGTGTGCCG AGGTGAGCT'] | 2750 | ['AAGYGTGTGCCT GTGTGCCGAGG'] | 2965 | ['AAGYGTGTGCCT GTGTGCCGAGG'] |
| NM_000061.2 (BTK):c.2T>C (p.Met1Thr) | 695 | BTK | 2581 | ['GGTGAACTCC AGAAAGAAGA AGCTAYGGCC GCAGTGATTCT GGAGAGCATC'] | 2751 | ['AGCTAYGGCCGC AGTGATTCTGG'] | 2966 | ['AGCTAYGGCCGC AGTGATTCTGG'] |
| NM_000061.2 (BTK):c.1223T>C (p.Leu408Pro) | 695 | BTK | 2582 | ['AAGGACCTGA CCTTCTTGAAG GAGCYGGGGA CTGGACAATTT GGGTAGTG'] | 2752 | ['AGCYGGGGACTG GACAATTTGGG'] | 2967-2968 | ['GAGCYGGGGACT GGACAATTTGG', 'AGCYGGGGACTG GACAATTTGGG'] |
| NM_000061.2 (BTK):c.1741T>C (p.Trp581Arg) | 695 | BTK | 2583 | ['CAAGTTCAGC AGCAAATCTG ACATTYGGGCT TTTGGTAAGTG GATAAGATT'] | 2753 | ['ACATTYGGGCTTT TGGTAAGTGG'] | 2969 | ['ACATTYGGGCTT TTGGTAAGTGG'] |
| NM_014009.3 (FOXP3):c.970T>C (p.Phe324Leu) | 50943 | FOXP3 | 2584 | ['GATTCATCCC CACCCTCTGAC AGAGYTCCTCC ACAACATGGA CTACTTCAA'] | 2754 | ['GACAGAGYTCCT CCACAACATGG'] | 2970 | ['GACAGAGYTCCT CCACAACATGG'] |
| NM_003688.3 (CASK):c.2740T>C (p.Trp914Arg) | 8573 | CASK | 2585 | ['TGAGCTCGTG TGCACAGCCCC ACAGYGGGTC CCTGTCTCCTG GGTCTATTA'] | 2755-2756 | ['CACAGYGGGTCC CTGTCTCCTGG', 'ACAGYGGGTCCCT GTCTCCTGGG'] | 2971-2972 | ['CACAGYGGGTCC CTGTCTCCTGG', 'ACAGYGGGTCCC TGTCTCCTGGG'] |
| NM_004992.3 (MECP2):c.464T>C (p.Phe155Ser) | 4204 | MECP2 | 2586 | ['GACACATCCC TGGACCCTAAT GATTBTGACTT CACGGTAACTG GGAGAGGG'] | 2757 | ['GATTBTGACTTCA CGGTAACTGG'] | 2973-2974 | ['GATTBTGACTTC ACGGTAACTGG', 'ATTBTGACTTCAC GGTAACTGGG'] |
| NM_000431.3 (MVK):c.803T>C (p.Ile268Thr) | 4598 | MVK | 2587 | ['ATCGTGGCCC CCCTCCTGACC TCAAYAGATG CCATCTCCCTG GAGTGTGAG'] | 2758 | ['CTCAAYAGATGC CATCTCCCTGG'] | 2975 | ['CTCAAYAGATGC CATCTCCCTGG'] |
| NM_021961.5 (TEAD1):c.1261T>C (p.Tyr?His) | 7003 | TEAD1 | 2588 | ['TGAACACGGA GCACAACATC ATATTYACAGG CTTGTAAAGGA CTGAACATG'] | 2759 | ['TCATATTYACAG GCTTGTAAAGG'] | 2976 | ['TCATATTYACAG GCTTGTAAAGG'] |
| NM_005633.3 (SOS1):c.1294T>C (p.Trp432Arg) | 6654 | SOS1 | 2589 | ['CGAGATTCAG AAGAATATTG ATGGTYGGGA GGGAAAAGAC ATTGGACAGTG'] | 2760 | ['GGTYGGGAGGGA AAAGACATTGG'] | 2977 | ['GGTYGGGAGGG AAAAGACATTGG'] |
| NM_006920.4 (SCN1A):c.3577T>C (p.Trp1193Arg) | −1 | — | 2590 | ['TGTGGAAGAA GGCAGAGGAA AACAAYGGTG GAACCTGAGA AGGACGTGTTT'] | 2761 | ['AACAAYGGTGGA ACCTGAGAAGG'] | 2978 | ['AACAAYGGTGG AACCTGAGAAGG'] |
| NM_000141.4 (FGFR2):c.1018T>C (p.Tyr340His) | 2263 | FGFR2 | 2591 | ['TGTAACTTTT GAGGACGCTG GGGAAYATAC GTGCTTGGCGG GTAATTCTAT'] | 2762-2763 | ['TGGGGAAYATAC GTGCTTGGCGG', 'GGGGAAYATACGT GCTTGGCGGG'] | 2979-2980 | ['TGGGGAAYATAC GTGCTTGGCGG', 'GGGGAAYATACG TGCTTGGCGGG'] |
| NM_000174.4 (GP9):c.70T>C (p.Cys24Arg) | 2815 | GP9 | 2592 | ['GGCCACCAAG GACTGCCCCAG CCCAYGTACCT GCCGCGCCCTG GAAACCAT'] | 2764 | ['CCCAYGTACCTG CCGCGCCCTGG'] | 2981 | ['CCCAYGTACCTG CCGCGCCCTGG'] |

TABLE 2-continued

T to C changes with NGG PAM. Table 2 shows a list of T to C mutations that may
be corrected using any of the base editors provided herein. GRNAs and gRNAall indicate the
protospacer and PAM sequence, where the PAM sequence is the last 3 nucleotides of each of
the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000175.3 (GPI):c.1574T>C (p.Ile525Thr) | 2821 | GPI | 2593 | ['CTGGGAAAGC AGCTGGCTAA GAAAABAGAG CCTGAGCTTGA TGGCAGTGCT'] | 2765 | ['AAAABAGAGCCT GAGCTTGATGG'] | 2982 | ['AAAABAGAGCCT GAGCTTGATGG'] |
| NM_000315.2 (PTH):c.52T>C (p.Cys18Arg) | 5741 | PTH | 2594 | ['AGTTATGATT GTCATGTTGGC AATTYGTTTTC TTACAAAATCG GATGGGAA'] | 2766 | ['AATTYGTTTTCTT ACAAAATCGG'] | 2983 | ['AATTYGTTTTCTT ACAAAATCGG'] |
| NM_000222.2 (KIT):c.1676T>C (p.Val559Ala) | 3815 | KIT | 2595 | ['CCCATGTATG AAGTACAGTG GAAGGNTGTT GAGGAGATAA ATGGAAACAAT'] | 2767 | ['AAGGNTGTTGAG GAGATAAATGG'] | 2984 | ['AAGGNTGTTGAG GAGATAAATGG'] |
| NM_016835.4 (MAPT):c.1839T>C (p.Asn613=) | 4137 | MAPT | 2596 | ['AGTCCAAGTG TGGCTCAAAG GATAAYATCA AACACGTCCCG GGAGGCGGCA'] | 2768-2769 | ['GGATAAYATCAA ACACGTCCCGG', 'GATAAYATCAAAC ACGTCCCGGG'] | 2985-2986 | ['GGATAAYATCAA ACACGTCCCGG', 'GATAAYATCAAA CACGTCCCGGG'] |
| NM_170707.3 (LMNA):c.1139T>C (p.Leu380Ser) | 4000 | LMNA | 2597 | ['GAGATCCACG CCTACCGCAAG CTCTYGGAGG GCGAGGAGGA GAGGTGGGCT'] | 2770 | ['TCTYGGAGGGCG AGGAGGAGAGG'] | 2987 | ['TCTYGGAGGGCG AGGAGGAGAGG'] |
| NM_000424.3 (KRT5):c.20T>C (p.Val7Ala) | 3852 | KRT5 | 2598 | ['GCCACCATGT CTCGCCAGTCA AGTGYGTCCTT CCGGAGCGGG GGCAGTCGT'] | 2771-2773 | ['TCAAGTGYGTCCT TCCGGAGCGG', 'CAAGTGYGTCCTT CCGGAGCGGG', 'AAGTGYGTCCTTC CGGAGCGGGG'] | 2988-2991 | ['TCAAGTGYGTCC TTCCGGAGCGG', 'CAAGTGYGTCCTT CCGGAGCGGG', 'AAGTGYGTCCTTC CGGAGCGGGG', 'AGTGYGTCCTTCC GGAGCGGGG'] |
| NM_000184.2 (HBG2):c.125T>C (p.Phe42Ser) | 3048 | HBG2 | 2599 | ['GTTGTCTACC CATGGACCCA GAGGTYCTTTG ACAGCTTTGGC AACCTGTCC'] | 2774 | ['CAGAGGTYCTTT GACAGCTTTGG'] | 2992 | ['CAGAGGTYCTTT GACAGCTTTGG'] |
| NM_000515.4 (GH1):c.291+6T>C | 2688 | GH1 | 2600 | ['AGGAAACAC AACAGAAATC CGTGAGYGGA TGCCTTCTCCC CAGGCGGGAT'] | 2775 | ['TGAGYGGATGCC TTCTCCCCAGG'] | 2993 | ['TGAGYGGATGCC TTCTCCCCAGG'] |
| NM_002087.3 GRN):c.2T>C (p.Met1Thr) | 2896 | GRN | 2601 | ['TCCTTGGTAC TTTGCAGGCAG ACCAYGTGGA CCCTGGTGAGC TGGGTGGCC'] | 2776 | ['CCAYGTGGACCC TGGTGAGCTGG'] | 2994 | ['CCAYGTGGACCC TGGTGAGCTGG'] |
| NM_001083112.2 (GPD2):c.1904T>C (p.Phe635Ser) | 2820 | GPD2 | 2602 | ['AGGTATAAGA AGAGATTTCAT AAGTYTGATGC AGACCAGAAA GGCTTTATT'] | 2777 | ['AAGTYTGATGCA GACCAGAAAGG'] | 2995 | ['AAGTYTGATGCA GACCAGAAAGG'] |
| NM_001018077.1(NR3C1):c.1712T>C (p.Val571Ala) | 2908 | NR3C1 | 2603 | ['CTCAACATGT TAGGAGGGCG GCAAGYGATT GCAGCAGTGA AATGGGCAAAG'] | 2778 | ['AAGYGATTGCAG CAGTGAAATGG'] | 2996 | ['AAGYGATTGCAG CAGTGAAATGG'] |
| NM_006306.3 (SMC1A):c.2351T>C (p.Ile784Thr) | 8243 | SMC1A | 2621 | ['GTGTTTGAAG AGTTTTGTCGG GAGAYTGGTG TGCGCAACATC CGGGAGTTT'] | 2798 | ['AGAYTGGTGTGC GCAACATCCGG'] | 3017 | ['AGAYTGGTGTGC GCAACATCCGG'] |
| NM_002242.4 (KCN.113):c.722T>C (p.Leu241Pro) | −1 | — | 2622 | ['TGGTGTAATG GAGTGATAGT ACGTTDGTGGA AAGATGAAGA ATGGACATTC'] | 2799 | ['GTTDGTGGAAAG ATGAAGAATGG'] | 3018 | ['GTTDGTGGAAAG ATGAAGAATGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000199.3 (SGSH):c.892T>C (p.Ser298Pro) | 6448 | SGSH | 2623 | ['CCCCAGCGTT TTGGGTGCTCC GGGGRTGACA CCAGTAAGGG TTCAGCAGTG'] | 2800 | ['TCCGGGGRTGAC ACCAGTAAGGG'] | 3019 | ['TCCGGGGRTGAC ACCAGTAAGGG'] |
| NM_020191.2 (MRPS22):c.644T>C (p.Leu215Pro) | 56945 | MRPS22 | 2624 | ['CCAATAATTT TCAAGGAAGA AAATCYTAGG GTAAGGTGACT TAGGTTTTAT'] | 2801 | ['ATCYTAGGGTAA GGTGACTTAGG'] | 3020 | ['ATCYTAGGGTAA GGTGACTTAGG'] |
| NM_017882.2 (CLN6):c.200T>C (p.Leu67Pro) | 54982 | CLN6 | 2625 | ['CCCCATTCTTC CATTTGCTCCG CAGCYGGTATT CCCTCTCGAGT GGTTTCCA'] | 2802 | ['AGCYGGTATTCC CTCTCGAGTGG'] | 3021 | ['AGCYGGTATTCC CTCTCGAGTGG'] |
| NM_014874.3 (MFN2):c.1392+2T>C | 9927 | MFN2 | 2626 | ['GTAGTCCTCA AGGTTTATAAG AATGWGAGTC ATGGAGCAAC AGGTCCTCTT'] | 2803 | ['AATGWGAGTCAT GGAGCAACAGG'] | 3022 | ['AATGWGAGTCA TGGAGCAACAGG'] |
| NM_024599.5 (RHBDF2):c.557T>C (p.Ile186Thr) | 79651 | RHBDF2 | 2627 | ['GCTTACCGCC CCCCTCCCTTC CAGAYTGTGG ATCCGCTGGCC CGGGGCCGG'] | 2804 | ['AGAYTGTGGATC CGCTGGCCCGG'] | 3023 | ['AGAYTGTGGATC CGCTGGCCCGG'] |
| NM_020894.2 (UVSSA):c.94T>C (p.Cys32Arg) | 57654 | UVSSA | 2628 | ['GAAAATGAA GGAACTGAAG AAAATTYGCA AGTATGTCTTA GGGTTCAGTAA'] | 2805 | ['AAAATTYGCAAG TATGTCTTAGG'] | 3024-3025 | ['AAAATTYGCAAG TATGTCTTAGG', 'AAAATTYGCAAGT ATGTCTTAGGG'] |
| NM_001161581.1 (POC1A):c.398T>C (p.Leu133Pro) | 25886 | POC1A | 2629 | ['GCCAGTGATG ACAAGACTGTT AAGCYGTGGG ACAAGAGCAG CCGGGAATGT'] | 2806 | ['AGCYGTGGGACA AGAGCAGCCGG'] | 3026 | ['AGCYGTGGGACA AGAGCAGCCGG'] |
| NM_005340.6 (HINT1):c.250T>C (p.Cys84Arg) | 3094 | HINT1 | 2630 | ['ACACTTAATG ATTGTTGGCAA GAAAYGTGCT GCTGATCTGGG CCTGAATAA'] | 2807-2808 | ['CAAGAAAYGTGC TGCTGATCTGG', 'AAGAAAYGTGCTG CTGATCTGGG'] | 3027-3028 | ['CAAGAAAYGTGC TGCTGATCTGG', 'AAGAAAYGTGCT GCTGATCTGGG'] |
| NM_000495 (COL4A5):c.438+2T>C | 1287 | COL4A5 | 2631 | ['TTTCCTGGTTT ACAGGGTCCTC CAGYAAGTTAT AAAATTTGGG ATTATGAT'] | 2809 | ['TCCAGYAAGTTA TAAAATTTGGG'] | 3029-3030 | ['CTCCAGYAAGTT ATAAAATTTGG', 'TCCAGYAAGTTA TAAAATTTGGG'] |
| NM_000344.3 (SMN1):c.388T>C (p.Tyr130His) | 6606 | SMN1 | 2632 | ['AACCTGTGTT GTGGTTTACAC TGGAYATGGA AATAGAGAGG AGCAAAATCT'] | 2810 | ['CACTGGAYATGG AAATAGAGAGG'] | 3031 | ['CACTGGAYATGG AAATAGAGAGG'] |
| NM_005334.2 (HCFC1):c.-970T>C | 3054 | HCFC1 | 2633 | ['TTAGTTGTTA CTTCTTCACAC AAGAYGGCGG CTCCCAGGGA GGAGGCATGA'] | 2811 | ['CAAGAYGGCGGC TCCCAGGGAGG'] | 3032 | ['CAAGAYGGCGG CTCCCAGGGAGG'] |
| NM_000431.3 (MVK):c.1039+2T>C | 4598 | MVK | 2634 | ['GTGGCATCAC ACTCCTCAAGC CAGGYATCCC GGGGTAGGT GGGCCAGGCT'] | 2812 | ['CCAGGYATCCCG GGGTAGGTGG'] | 3033-3034 | ['CCAGGYATCCCG GGGTAGGTGG', 'CAGGYATCCCGG GGTAGGTGGG'] |
| NM_018344.5 (SLC29A3):c.607T>C (p.Ser203Pro) | 55315 | SLC29A3 | 2635 | ['TATGAGGAAC TCCCAGGCACT GATAYCAGGT GAGAGCCAGG GTCCGGGCAG'] | 2813 | ['ACTGATAYCAGG TGAGAGCCAGG'] | 3035-3036 | ['ACTGATAYCAGG TGAGAGCCAGG', 'CTGATAYCAGGT GAGAGCCAGGG'] |
| NM_000108.4 (DLD):c.140T>C (p.Ile47Thr) | 1738 | DLD | 2636 | ['GTAGTTGATG CTGATGTAACA GTTAYAGGTTC TGGTCCTGGAG GATATATGTT'] | 2815 | ['ACAGTTAYAGGT TCTGGTCCTGG', 'GTTAYAGGTTCTG GTCCTGGAGG'] | 3037-3038 | ['ACAGTTAYAGGT TCTGGTCCTGG', 'GTTAYAGGTTCTG GTCCTGGAGG'] |

TABLE 2-continued

T to C changes with NGG PAM. Table 2 shows a list of T to C mutations that may
be corrected using any of the base editors provided herein. GRNAs and gRNAall indicate the
protospacer and PAM sequence, where the PAM sequence is the last 3 nucleotides of each of
the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_004333.4 (BRAF):c.1403T>C (p.Phe468Ser) | 673 | BRAF | 2637 | ['GGACAAAGA ATTGGATCTGG ATCATYTGGAA CAGTCTACAAG GGAAAGTGG'] | 2816-2817 | ['ATCATYTGGAAC AGTCTACAAGG', 'TCATYTGGAACAG TCTACAAGGG'] | 3039-3040 | ['ATCATYTGGAAC AGTCTACAAGG', 'TCATYTGGAACA GTCTACAAGGG'] |
| NM_000540.2 (RYR1):c.1205T>C (p.Met402Thr) | 6261 | RYR1 | 2638 | ['CAGGAGGAGT CCCAGGCCGCC CGCAYGATCC ACAGCACCAA TGGCCTATAC'] | 2818 | ['CGCAYGATCCAC AGCACCAATGG'] | 3041 | ['CGCAYGATCCAC AGCACCAATGG'] |
| NM_000256.3 (MYBPC3):c.1351+2T>C | 4607 | MYBPC3 | 2639 | ['GTAGCACGGA GCTCTTTGTGA AAGGYGGGCC TGGGACCTGA GGATGTGGGA'] | 2819 | ['AAAGGYGGGCCT GGGACCTGAGG'] | 3042 | ['AAAGGYGGGCCT GGGACCTGAGG'] |
| NM_000256.3 (MYBPC3):c.821+2T>C | 4607 | MYBPC3 | 2640 | ['CCTCCTATCA GCCTTCCGCCG CACGYGAGTG GCCATCCTCAG GGCCTGGGG'] | 2820 | ['CACGYGAGTGGC CATCCTCAGGG'] | 3043-3044 | CCATCCTCAGG', 'CACGYGAGTGGC CATCCTCAGGG'] |
| NM_000257.3 (MYH7):c.2546T>C (p.Met849Thr) | 4625 | MYH7 | 2641 | ['AAGAGTGCAG AAAGAGAGAA GGAGAYGGCC TCCATGAAGG AGGAGTTCACA'] | 2821 | ['GGAGAYGGCCTC CATGAAGGAGG'] | 3045 | ['GGAGAYGGCCTC CATGAAGGAGG'] |
| NM_206933.2 (USH2A):c.1606T>C (p.Cys536Arg) | 7399 | USH2A | 2642 | ['CGACACAACA AGCCAGCCAT ATAGAYGCCTC TGCTCCCAGGA GAGCTTCAC'] | 2822 | ['ATATAGAYGCCT CTGCTCCCAGG'] | 3046 | ['ATATAGAYGCCT CTGCTCCCAGG'] |
| NM_000059.3 (BRCA2):c.316+2T>C | 675 | BRCA2 | 2643 | ['TAGATAAATT CAAATTAGACT TAGGYAAGTA ATGCAATATGG TAGACTGGG'] | 2823 | ['CTTAGGYAAGTA ATGCAATATGG'] | 3047 | ['CTTAGGYAAGTA ATGCAATATGG'] |
| NM_007294.3 (BRCA1):c.5291T>C (p.Leu1764Pro) | 672 | BRCA1 | 2644 | ['CTCTTCTTCC AGATCTTCAGG GGGCYAGAAA TCTGTTGCTAT GGGCCCTTC'] | 2824 | ['GGCYAGAAATCT GTTGCTATGG'] | 3048-3049 | ['GGGCYAGAAATC TGTTGCTATGG', 'GGCYAGAAATCT GTTGCTATGGG'] |
| NM_001130089.1(KARS):c.517T>C (p.Tyr173His) | 3735 | KARS | 2645 | ['AGCTTCTGGG GGAAAGCTCA TCTTCYATGAT CTTCGAGGAG AGGGGGTGAA'] | 2825 | ['TTCYATGATCTTC GAGGAGAGGG'] | 3050-3051 | ['CTTCYATGATCT TCGAGGAGAGG', 'TTCYATGATCTTC GAGGAGAGGG'] |
| NM_001283009.1(RTEL1):c.3730T>C (p.Cys1244Arg) | −1 | — | 2646 | ['CGGGCCCCTC TCAGCAGGCT TGTGYGCCAG GGCTGTGGGG CAGAGGACGT'] | 2826 | ['CTGTGTGYGCCA GGGCTGTGGGG'] | 3052 | ['CTGTGTGYGCCA GGGCTGTGGGG'] |
| NM_005554.3 (KRT6A):c.1406T>C (p.Leu469Pro) | 3853 | KRT6A | 2647 | ['GAGATCGCCA CCTACCGCAAG CTGCBGGAGG GTGAGGAGTG CAGGTGGGTA'] | 2827 | ['TGCBGGAGGGTG AGGAGTGCAGG'] | 3053 | ['TGCBGGAGGGTG AGGAGTGCAGG'] |
| NM_000218.2 (KCNQ1):c.550T>C (p.Tyr184His) | 3784 | KCNQ1 | 2648 | ['CTGGTCCGCC GGCTGCCGCA GCAAGBACGT GGGCCTCTGGG GGCGGCTGCG'] | 2828 | ['AGCAAGBACGTG GGCCTCTGGGG'] | 3054-3056 | ['CAGCAAGBACGT GGGCCTCTGGGG', 'AGCAAGBACGTG GGCCTCTGGGG', 'GCAAGBACGTGG |
| NM_198056.2 (SCN5A):c.5624T>C (p.Met1875Thr) | 6331 | SCN5A | 2649 | ['GAGATGGACG CCCTGAAGATC CAGAHGGAGG AGAAGTTCATG GCAGCCAAC'] | 2829 | ['CCAGAHGGAGGA GAAGTTCATGG'] | 3057 | ['CCAGAHGGAGG AGAAGTTCATGG'] |
| NM_006920.4 (SCN1A):c.269T>C (p.Phe90Ser) | 6323 | SCN1A | 2650 | ['TGTTGTGTTC CTGTCTTACAG ACTTYTATAGT ATTGAATAAA GGGAAGGCC'] | 2830-2831 | ['ACTTYTATAGTAT TGAATAAAGG', 'CTTYTATAGTATT GAATAAAGGG'] | 3058-3059 | ['ACTTYTATAGTA TTGAATAAAGG', 'CTTYTATAGTATT GAATAAAGGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_006920.4 (SCN1A):c.272T>C (p.Ile91Thr) | 6323 | SCN1A | 2651 | ['TGTGTTCCTG TCTTACAGACT TTTAYAGTATT GAATAAAGGG AAGGCCATC'] | 2832-2833 | ['ACTTTTAYAGTAT TGAATAAAGG', 'CTTTTAYAGTATT GAATAAAGGG'] | 3060-3061 | ['ACTTTTAYAGTA TTGAATAAAGG', 'CTTTTAYAGTATT GAATAAAGGG'] |
| NM_006514.3 (SCN10A):c.1661T>C (p.Leu554Pro) | 6336 | SCN10A | 2652 | ['GGAGTCAGGG TTGCTGGGTTG AGGARGAGGG CTTCTAGGGAG GGGGCCTTG'] | 2834-2836 | ['GAGGARGAGGGC TTCTAGGGAGG', 'AGGARGAGGGCTT CTAGGGAGGG', 'GGARGAGGGCTTC TAGGGAGGGG'] | 3062-3064 | ['GAGGARGAGGG CTTCTAGGGAGG', 'AGGARGAGGGCT TCTAGGGAGGG', 'GGARGAGGGCTT CTAGGGAGGGG'] |
| NM_000251.2 (MSH2):c.2005+2T>C | 4436 | MSH2 | 2653 | ['AACAGATGTT CCACATCATTA CTGGYAAAAA ACCTGGTTTTT GGGCTTTGT'] | 2837-2838 | ['CTGGYAAAAAAC CTGGTTTTTGG', 'TGGYAAAAAACCT GGTTTTTGGG'] | 3065-3066 | ['CTGGYAAAAAAC CTGGTTTTTGG', 'TGGYAAAAAACC TGGTTTTTGGG'] |
| NM_000251.2 (MSH2):c.595T>C (p.Cys199Arg) | 4436 | MSH2 | 2654 | ['CCTCATCCAG ATTGGACCAA AGGAAYGTGT TTACCCGGAG GAGAGACTGC'] | 2839 | ['AAGGAAYGTGTT TTACCCGGAGG'] | 3067 | ['AAGGAAYGTGTT TTACCCGGAGG'] |
| NM_001005741.2 (GBA):c.667T>C (p.Trp223Arg) | 2629 | GBA | 2655 | ['TTCACCGCTC CATTGGTCTTG AGCCRAGTGG GTGATGTCCAG GGGCTGGCA'] | 2840 | ['GCCRAGTGGGTG ATGTCCAGGGG'] | 3068-3070 | ['GAGCCRAGTGGG TGATGTCCAGG', 'AGCCRAGTGGGT GATGTCCAGGG', 'GCCRAGTGGGTG ATGTCCAGGGG'] |
| NM_003494.3 (DYSF):c.1284+2T>C | 8291 | DYSF | 2656 | ['GAGGTCAGCT TTGCGGGGAA AATGGYAAGG AGCAAGGGAG CAGGAGGGTTC'] | 2841 | ['ATGGYAAGGAGC AAGGGAGCAGG'] | 3071 | ['ATGGYAAGGAG CAAGGGAGCAGG'] |
| NM_012463.3 (ATP6V0A2):c.825+2T>C | 2354 | ATP6V50A2 | 2657 | ['ACCCGCATCC AGGATCTCTAC ACTGYGAGTA AGCTGGAAGT GGATTGCCTC'] | 2842 | ['CACTGYGAGTAA GCTGGAAGTGG'] | 3072 | ['CACTGYGAGTAA GCTGGAAGTGG'] |
| NM_016725.2 (FOLR1):c.493+2T>C | 2348 | FOLR1 | 2658 | ['ACAAGGGCTG GAACTGGACTT CAGGYGAGGG CTGGGGTGGG CAGGAATGGA'] | 2843 | ['AGGYGAGGGCTG GGGTGGGCAGG'] | 3073-3074 | ['CTTCAGGYGAGG GCTGGGGTGGG', 'AGGYGAGGGCTG GGGTGGGCAGG'] |
| NM_003764.3 (STX11):c.173T>C (p.Leu58Pro) | 8676 | STX11 | 2659 | ['GACATTCAGG ATGAAAACCA GCTGCYGGTG GCCGACGTGA AGCGGCTGGGA'] | 2844 | ['TGCYGGTGGCCG ACGTGAAGCGG'] | 3075 | ['TGCYGGTGGCCG ACGTGAAGCGG'] |
| NM_014714.3 (1FT140):c.4078T>C (p.Cys1360Arg) | 9742 | IFT140 | 2660 | ['GGACCCCAAG GAGTCCATCAA GCAGYGTGAG CTGCTCCTGGA GGAACCAGA'] | 2845 | ['GCAGYGTGAGCT GCTCCTGGAGG'] | 3076-3077 | ['CAAGCAGYGTGA GCTGCTCCTGG', 'GCAGYGTGAGCT GCTCCTGGAGG'] |
| NM_000531.5 (OTC):c.1005+2T>C | 5009 | OTC | 2661 | ['GAAAACAGA AAGTGGACAA TCATGGYAAG CAAGAAACAA GGAATGGAGGAT'] | 2846 | ['ATCATGGYAAGC AAGAAACAAGG'] | 3078 | ['ATCATGGYAAGC AAGAAACAAGG'] |
| NM_000531.5 (OTC):c.158T>C (p.Ile53Thr) | 5009 | OTC | 2662 | ['CTAAAAAACT TACCGGAGA AGAAABTAAA TATATGCTATG GCTATCAGCA'] | 2847 | ['AAGAAABTAAAT ATATGCTATGG'] | 3079 | ['AAGAAABTAAAT ATATGCTATGG'] |
| NM_000531.5 (OTC):c.284T>C (p.Leu95Ser) | 5009 | OTC | 2663 | ['GAGAAAAGA AGTACTCGAAC AAGATYGTCTA CAGAAACAGG TAAGTCCACT'] | 2848 | ['ACAAGATYGTCT ACAGAAACAGG'] | 3080 | ['ACAAGATYGTCT ACAGAAACAGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000531.5 (OTC):c.2T>C (p.Met1Thr) | 5009 | OTC | 2664 | ['CGTCCTTTAC ACAATTAAAA GAAGAYGCTG TTTAATCTGAG GATCCTGTTA'] | 2849 | ['AGAAGAYGCTGT TTAATCTGAGG'] | 3081 | ['AGAAGAYGCTGT TTAATCTGAGG'] |
| NM_000531.5 (OTC):c.526T>C (p.Tyr176His) | 5009 | OTC | 2665 | ['CCATCCTATC CAGATCCTGGC TGATYACCTCA CGCTCCAGGTT GGTTTATT'] | 2850 | ['GGCTGATYACCT CACGCTCCAGG'] | 3082-3083 | ['GGCTGATYACCT CACGCTCCAGG', 'GATYACCTCACG CTCCAGGTTGG'] |
| NM_000531.5 (OTC):c.779T>C (p.Leu260Ser) | 5009 | OTC | 2666 | ['GAAGCAGCGC ATGGAGGCAA TGTATYAATTA CAGACACTTGG ATAAGCATG'] | 2851 | ['ATGTATYAATTAC AGACACTTGG'] | 3084 | ['ATGTATYAATTA CAGACACTTGG'] |
| NM_000322.4 (PRPH2):c.736T>C (p.Trp246Arg) | 5961 | PRPH2 | 2667 | ['CCACCAGACG GAGGAGCTCA ACCTGYGGGT GCGTGGCTGCA GGGCTGCCCT'] | 2852-2853 | ['ACCTGYGGGTGC GTGGCTGCAGG', 'CCTGYGGGTGCGT GGCTGCAGGG'] | 3085-3086 | ['ACCTGYGGGTGC GTGGCTGCAGG', 'CCTGYGGGTGCG TGGCTGCAGGG'] |
| NM_000211.4 (ITGB2):c.1877+2T>C | 3689 | ITGB2 | 2668 | ['CCCCTCACCC TGTGGCAAGTA CATGYGAGTG CAGGCGGAGC AGGCAGGGCG'] | 2854 | ['CATGYGAGTGCA GGCGGAGCAGG'] | 3087 | ['CATGYGAGTGCA GGCGGAGCAGG'] |
| NM_015474.3 (SAMHD1):c.1106T>C (p.Leu369Ser) | 25939 | SAMHD1 | 2669 | ['TTTGTGTTGA TAAGCTCTACG GTGTRAAGAGT TGCGAGTGTGG AACATGTC'] | 2855 | ['GGTGTRAAGAGT TGCGAGTGTGG'] | 3088 | ['GGTGTRAAGAGT TGCGAGTGTGG'] |
| NM_001101.3 (ACTB):c.356T>C (p.Met119Thr) | 60 | ACTB | 2670 | ['AACCCCAAGG CCAACCGCGA GAAGAYGACC CAGGTGAGTG GCCCGCTACCT'] | 2856 | ['GAGAAGAYGACC CAGGTGAGTGG'] | 3089 | ['GAGAAGAYGAC CCAGGTGAGTGG'] |
| NM_015713.4 (RRM2B):c.368T>C (p.Phe123Ser) | 50484 | RRM2B | 2671 | ['CTCGATGAGA ATTTGAAAGCC ATAGRAACAG CGAGCCTCTGG AACCTGCAC'] | 2857 | ['CCATAGRAACAG CGAGCCTCTGG'] | 3090 | ['CCATAGRAACAG CGAGCCTCTGG'] |
| NM_015599.2 (PGM3):c.248T>C (p.Leu83Ser) | 5238 | PGM3 | 2672 | ['TTGGTTGATC CTTTGGGTGAA ATGTYGGCACC ATCCTGGGAG GAACATGCC'] | 2858 | ['AATGTYGGCACC ATCCTGGGAGG'] | 3091 | ['AATGTYGGCACC ATCCTGGGAGG'] |
| NM_002136.2 (HNRNPA1):c.817T>C (p.Phe273Leu) | 3178 | HNRNPA1 | 2673 | ['GAATTACAAC AATCAGTCTTC AAATBTTGGAC CCATGAAGGG AGGAAATTT'] | 2859-2861 | ['TTCAAATBTTGGA CCCATGAAGG', 'TCAAATBTTGGAC CCATGAAGGG', 'AATBTTGGACCCA TGAAGGGAGG'] | 3092-3094 | ['TTCAAATBTTGG ACCCATGAAGG', 'TCAAATBTTGGAC CCATGAAGGG', 'AATBTTGGACCC ATGAAGGGAGG'] |
| NM_002136.2 (HNRNPA1):c.841T>C (p.Phe281Leu) | 3178 | HNRNPA1 | 2674 | ['TTTTGGACCC ATGAAGGGAG GAAATYTTGG AGGCAGAAGC TCTGGCCCCTA'] | 2862 | ['AATYTTGGAGGC AGAAGCTCTGG'] | 3095 | ['AATYTTGGAGGC AGAAGCTCTGG'] |
| NM_022552.4 (DNMT3A):c.2705T>C (p.Phe902Ser) | 1788 | DNMT3A | 2675 | ['CGCAAAATAC TCCTTCAGCGG AGCGRAGAGG TGGCGGATGA CTGGCACGCT'] | 2863 | ['GCGRAGAGGTGG CGGATGACTGG'] | 3096 | ['GCGRAGAGGTGG CGGATGACTGG'] |
| NM_000076.2 (CDKN1C):c.*5+2T>C | 1028 | CDKN1C | 2676 | ['GCGCAAGAG GCTGCGGTGA GCCAAGYGAG TACAGCGCACC TGGGGGGGCGC'] | 2864-2866 | ['CCAAGYGAGTAC AGCGCACCTGG', 'CAAGYGAGTACA GCGCACCTGGG', 'AAGYGAGTACAG CGCACCTGGGG'] | 3097-3099 | ['CCAAGYGAGTAC AGCGCACCTGG', 'CAAGYGAGTACA GCGCACCTGGG', 'AAGYGAGTACAG CGCACCTGGGG'] |
| NC_012920.1:m.9478T>C | 4514 | MTCO3 | 2677 | ['ATAATCCTAT TTATTACCTCA GAAGYTTTTT | 2867 | ['TCAGAAGYTTTT TCTTCGCAGG'] | 3100 | ['TCAGAAGYTTTT TCTTCGCAGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_002049.3 (GATA1):c.2T>C (p.Met1Thr) | 2623 | GATA1 | 2678 | ['CGCAGGTTAA TCCCCAGAGGC TCCAYGGAGTT CCCTGGCCTGG GGTCCCTG'] <br>(preceded by 'CTTCGCAGGAT TTTTCTGA']) | 2868-2869 | ['TCCAYGGAGTTC CTGGCCTGGG', 'CCAYGGAGTTCCC TGGCCTGGGG'] | 3101-3103 | ['CTCCAYGGAGTT CCCTGGCCTGG', 'TCCAYGGAGTTC CCTGGCCTGGG', 'CCAYGGAGTTCC CTGGCCTGGGG'] |
| NM_005740.2 (DNAL4):c.153+2T>C | 10126 | DNAL4 | 2679 | ['GAGAAATTCT CCAACAACAA CGAGGYATTG CCAGCAGTGC AGGCGGCCCT'] | 2870 | ['CGAGGYATTGCC AGCAGTGCAGG'] | 3104 | ['CGAGGYATTGCC AGCAGTGCAGG'] |
| NM_001287223.1 (SCN11A):c.1142T>C (p.Ile381Thr) | 11280 | SCN11A | 2680 | ['GGGCTCTACT CAGTCTTCTTC TTCAYTGTGGT CATTTTCCTGG GCTCCTTC'] | 2871 | ['TTCAYTGTGGTCA TTTTCCTGGG'] | 3105-3106 | ['CTTCAYTGTGGT CATTTTCCTGG', 'TTCAYTGTGGTCA TTTTCCTGGG'] |
| NM_001302946.1 (TRNT1):c.497T>C (p.Leu166Ser) | 51095 | TRNT1 | 2681 | ['TAATGAATAG GTTTTGATGGC ACTTYATTTGA CTACTTTAATG GTTATGAA'] | 2872 | ['ACTTYATTTGACT ACTTTAATGG'] | 3107 | ['ACTTYATTTGAC TACTTTAATGG'] |
| NM_178151.2 (DCX):c.2T>C (p.Met1Thr) | 1641 | DCX | 2682 | ['AGGTCTCTGA GGTTCCACCAA AATAYGGAAC TTGATTTTGGA CACTTTGAC'] | 2873 | ['CAAAATAYGGAA CTTGATTTTGG'] | 3108 | ['CAAAATAYGGA ACTTGATTTTGG'] |
| NM_000169.2 (GLA):c.758T>C (p.Ile253Thr) | -1 | — | 2683 | ['TGGACATCTT TTAACCAGGA GAGAAYTGTT GATGTTGCTGG ACCAGGGGT'] | 2874 | ['GAGAGAAYTGTT GATGTTGCTGG'] | 3109 | ['GAGAGAAYTGTT GATGTTGCTGG'] |
| NM_170707.3 (LMNA):c.710T>C (p.Phe237Ser) | 4000 | LMNA | 2684 | ['ATTGACAATG GGAAGCAGCG TGAGTYTGAG AGCCGGCTGG CGGATGCGCTG'] | 2875 | ['TGAGTYTGAGAG CCGGCTGGCGG'] | 3110 | ['TGAGTYTGAGAG CCGGCTGGCGG'] |
| NM_000256.3 (MYBPC3):c.3330+2T>C | 4607 | MYBPC3 | 2685 | ['CAGAAAGCCG ACAAGAAGAC CATGGBGAGC CCAGGGTCTGG GGTCCCCACG'] | 2876-2878 | ['ACCATGGBGAGC CCAGGGTCTGG', 'CCATGGBGAGCCC AGGGTCTGGG', 'CATGGBGAGCCCA GGGTCTGGGG'] | 3111-3113 | ['ACCATGGBGAGC CCAGGGTCTGG', 'CCATGGBGAGCC CAGGGTCTGGG', 'CATGGBGAGCCC AGGGTCTGGGG'] |
| NM_005957.4 (MTHFR):c.1530+2T>C | 4524 | MTHFR | 2686 | ['AGCGGGGGCT ATGTCTTCCAG AAGGYGTGGT AGGGAGGCAC GGGGTGCCCC'] | 2879-2881 | ['GAAGGYGTGGTA GGGAGGCACGG', 'AAGGYGTGGTAG GGAGGCACGGG', 'AGGYGTGGTAGG GAGGCACGGGG'] | 3114-3116 | ['GAAGGYGTGGTA GGGAGGCACGG', 'AAGGYGTGGTAG GGAGGCACGGG', 'AGGYGTGGTAGG GAGGCACGGGG'] |
| NM_000264.3 (PTCH1):c.3168+2T>C | 5727 | PTCH1 | 2687 | ['AACCCCTGGA CGGCCGGGAT CATTGYGAGTG TATTATAAGGG GCTTTGTGG'] | 2882-2884 | ['ATCATTGYGAGT GTATTATAAGG', 'TCATTGYGAGTGT ATTATAAGGG', 'CATTGYGAGTGTA TTATAAGGGG'] | 3117-3119 | ['ATCATTGYGAGT GTATTATAAGG', 'TCATTGYGAGTGT ATTATAAGGG', 'CATTGYGAGTGT ATTATAAGGGG'] |
| NM_000030.2 (AGXT):c.322T>C (p.Trp108Arg) | 189 | AGXT | 2688 | ['CTTCCTGGTT GGGGCCAATG GCATTYGGGG GCAGCGAGCC GTGGACATCGG'] | 2885 | ['CATTYGGGGCA GCGAGCCGTGG'] | 3120 | ['CATTYGGGGCA GCGAGCCGTGG'] |
| NM_000023.2 (SGCA):c.371T>C (p.Ile124Thr) | 6442 | SGCA | 2689 | ['ACTCGGCAGA GGCTGGTGCTG GAGAYTGGGG ACCCAGAAGG TACCTCTAGC'] | 2886 | ['CTGGAGAYTGGG GACCCAGAAGG'] | 3121 | ['CTGGAGAYTGGG GACCCAGAAGG'] |
| NM_001103.3 (ACTN2):c.683T>C (p.Met228Thr) | 88 | ACTN2 | 2690 | ['GAGAAGCACC TGGATATTCCT AAAAYGTTGG ATGCTGAAGGT GAGATGAAA'] | 2887 | ['CCTAAAAYGTTG GATGCTGAAGG'] | 3122 | ['CCTAAAAYGTTG GATGCTGAAGG'] |

TABLE 2-continued

T to C changes with NGG PAM. Table 2 shows a list of T to C mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_001165963.1 (SCN1A):c.4055T>C (p.Leu1352Pro) | −1 | — | 2691 | ['ATTCCATCCA TCATGAATGTG CTTCYGGTTTG TCTTATATTCT GGCTAATT'] | 2888 | ['TTCYGGTTTGTCT TATATTCTGG'] | 3123 | ['TTCYGGTTTGTC TTATATTCTGG'] |
| NM_001165963.1 (SCN1A):c.1265T>C (p.Val422Ala) | 6323 | SCN1A | 2692 | ['CTAATAAATT TGATCCTGGCT GTGGHGGCCA TGGCCTACGAG GAACAGAAT'] | 2889 | ['TGTGGHGGCCAT GGCCTACGAGG'] | 3124 | ['TGTGGHGGCCAT GGCCTACGAGG'] |
| NM_000426.3 (LAMA2):c.8282T>C (p.Ile2761Thr) | 3908 | LAMA2 | 2693 | ['GCAGAATCAG AACCAGCTCTT TTGAYAGGGA GCAAGCAGTTC GGGCTTTCA'] | 2890-2891 | ['TTGAYAGGGAGC AAGCAGTTCGG', 'TGAYAGGGAGCA AGCAGTTCGGG'] | 3125-3126 | ['TTGAYAGGGAGC AAGCAGTTCGG', 'TGAYAGGGAGCA AGCAGTTCGGG'] |
| NM_000257.3 (MYH7):c.5117T>C (p.Leu1706Pro) | −1 | — | 2694 | ['TCCCGGAAGC TGGCGGAGCA GGAGCYGATT GAGACTAGTG AGCGGGTGCAG'] | 2892 | ['AGCYGATTGAGA CTAGTGAGCGG'] | 3127 | ['AGCYGATTGAGA CTAGTGAGCGG'] |
| NM_001399.4 (EDA):c.396+2T>C | 1896 | EDA | 2695 | ['TCTGACTCCC AGGACGGGCA CCAGGKGAGT CACCTAGTAGG GGCGGCGGCG'] | 2893-2894 | ['ACCAGGKGAGTC ACCTAGTAGGG', 'CCAGGKGAGTCAC CTAGTAGGGG'] | 3128-3130 | ['CACCAGGKGAGT CACCTAGTAGG', 'ACCAGGKGAGTC ACCTAGTAGGG', 'CCAGGKGAGTCA CCTAGTAGGGG'] |
| NM_001848.2 (COL6A1):c.957+2T>C | 1291 | COL6A1 | 2696 | ['TCCAGGGGAC CCAAGGGCTA CAAGGYGAGC GTGGGCTGCTG GGAGGGGGA'] | 2895-2896 | ['ACAAGGYGAGCG TGGGCTGCTGG', 'CAAGGYGAGCGT GGGCTGCTGGG'] | 3131-3132 | ['ACAAGGYGAGC GTGGGCTGCTGG', 'CAAGGYGAGCGT GGGCTGCTGGG'] |
| NM_000238.3 (KCNH2):c.1945+6T>C | 3757 | KCNH2 | 2697 | ['CTGCGTCATG CTCATTGGCTG TGAGYGTGCCC AGGGGCGGGC GGCGGGGAG'] | 2897-2898 | ['CTGTGAGYGTGC CCAGGGGCGGG', 'TGAGYGTGCCCAG GGGCGGGCGG'] | 3133-3134 | ['CTGTGAGYGTGC CCAGGGGCGGG', 'TGAGYGTGCCCA GGGGCGGGCGG'] |
| NM_021007.2 (SCN2A):c.1271T>C (p.Val424Ala) | 6326 | SCN2A | 2698 | ['CTAATAAATT TGATCTTGGCT GTGGYGGCCA TGGCCTATGAG GAACAGAAT'] | 2899 | ['TGTGGYGGCCAT GGCCTATGAGG'] | 3135 | ['TGTGGYGGCCAT GGCCTATGAGG'] |
| NM_021007.2 (SCN2A):c.4308+2T>C | 6326 | SCN2A | 2699 | ['TATGCAGCTG TTGATTCACGA AATGYAAGTCT AGTTAGAGGG AAATTGTTT'] | 2900-2901 | ['CGAAATGYAAGT CTAGTTAGAGG', 'GAAATGYAAGTCT AGTTAGAGGG'] | 3136-3137 | ['CGAAATGYAAGT CTAGTTAGAGG', 'GAAATGYAAGTC TAGTTAGAGGG'] |
| NM_000083.2 (CLCN1):c.1283T>C (p.Phe428Ser) | 1180 | CLCN1 | 2700 | ['CCCCGCGAAG CCATCAGTACT TTGTYTGACAA CAATACATGG GTGAAACAC'] | 2902-2903 | ['CTTTGTYTGACAA CAATACATGG', 'TTTGTYTGACAAC AATACATGGG'] | 3138-3139 | ['CTTTGTYTGACA ACAATACATGG', 'TTTGTYTGACAAC AATACATGGG'] |
| NM_004550.4 (NDUFS2):c.875T>C (p.Met292Thr) | 4720 | NDUFS2 | 2701 | ['CATTATGCTC TCCACAGTGGA GTGAYGCTTCG GGGCTCAGGC ATCCAGTGG'] | 2904 | ['GGAGTGAYGCTT CGGGGCTCAGG'] | 3140 | ['GGAGTGAYGCTT CGGGGCTCAGG'] |
| NM_000546.5 (TP53):c.584T>C (p.Ile195Thr) | 7157 | TP53 | 2702 | ['CACACGCAAA TTTCCTTCCAC TCGGRTAAGAT GCTGAGGAGG GGCCAGACC'] | 2905-2906 | ['CTCGGRTAAGAT GCTGAGGAGGG', 'TCGGRTAAGATGC TGAGGAGGGG'] | 3141-3143 | ['ACTCGGRTAAGA TGCTGAGGAGG', 'CTCGGRTAAGAT GCTGAGGAGGG', 'TCGGRTAAGATG CTGAGGAGGGG'] |

TABLE 3

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_017547.3 (FOXRED1):c.1289A>G (p.Asn430Ser) | 55572 | FOXRED1 | 5084 | ['GTGGGCCCCCACC CGCTAGTTGTCAVC ATGTACTTTGCTACT GGCTTCAGT'] | 5261 | ['CCACCCGCTAGT TGTCAVCATGT'] | 5464-5466 | ['CCCACCCGCTAG TTGTCAVCATG', 'CCACCCGCTAGTT GTCAVCATGT', 'CCCGCTAGTTGTC AVCATGTACT'] |
| NM_000071.2 (CBS):c.1150A>G (p.Lys384Glu) | 875 | CBS | 5085 | ['GGTGACTCCCCCAT CCCGCAGGACCRAG TTCCTGAGCGACAG GTGGATGCT'] | 5262 | ['CCCCATCCCGCA GGACCRAGTTC'] | 5467-5470 | ['CCCCCATCCCGC AGGACCRAGTT', 'CCCCATCCCGCA GGACCRAGTTC', 'CCCATCCCGCAG GACCRAGTTCC', 'CCATCCCGCAGG ACCRAGTTCCT'] |
| NM_000552.3 (VWF):c.2384A>G (p.Tyr795Cys) | 7450 | VWF | 5086 | ['GAGTGTACCAAAA CGTGCCAGAACTRT GACCTGGAGTGCAT GAGCATGGGC'] | 5263 | ['CCAAAACGTGCC AGAACTRTGAC'] | 5471 | ['CCAAAACGTGCC AGAACTRTGAC'] |
| NM_000552.3 (VWF):c.1583A>G (p.Asn528Ser) | 7450 | VWF | 5087 | ['ACCTGCGGCCTGT GTGGGAATTACART GGCAACCAGGGCGA CGACTTCCTT'] | 5264 | ['CCTGTGTGGGAA TTACARTGGCA'] | 5472 | ['CCTGTGTGGGAA TTACARTGGCA'] |
| NM_000308.2 (CTSA):c.1238A>G (p.Tyr413Cys) | 5476 | CTSA | 5088 | ['CTTTAGAAATACC AGATCCTATTATRTA ATGGAGATGTAGAC ATGGCCTGC'] | 5265 | ['CCAGATCCTATT ATRTAATGGAG'] | 5473 | ['CCAGATCCTATT ATRTAATGGAG'] |
| NM_000277.1 (PAH):c.916A>G (p.Ile306Val) | 5053 | PAH | 5089 | ['TTCTATTTTCCCCC AATTACAGGAARTT GGCCTTGCCTCTCTG GGTGCACC'] | 5266 | ['CCCCCAATTACA GGAARTTGGCC'] | 5474-5476 | ['CCCCCAATTACA GGAARTTGGCC', 'CCCCAATTACAG GAARTTGGCCT', 'CCCAATTACAGG AARTTGGCCTT'] |
| NM_000512.4 (GALNS):c.1460A>G (p.Asn487Ser) | 2588 | GALNS | 5090 | ['TTGGTCCCCGCGCA GCCCCAGCTCARCG TGTGCAACTGGGCG GTCATGGTA'] | 5267 | ['CCGCGCAGCCCC AGCTCARCGTG'] | 5477 | ['CCGCGCAGCCCC AGCTCARCGTG'] |
| NM_013319.2 (UBIAD1):c.305A>G (p.Asn102Ser) | 29914 | UBIAD1 | 5091 | ['GTGCACGGGGCCG GTAATTTGGTCARC ACTTACTATGACTTT TCCAAGGGC'] | 5268 | ['CCGGTAATTTGG TCARCACTTAC'] | 5478 | ['CCGGTAATTTGG TCARCACTTAC'] |
| NM_013319.2 (UBIAD1):c.695A>G (p.Asn232Ser) | 29914 | UBIAD1 | 5092 | ['AGCACCGAGGCCA TTCTCCATTCCARCA ACACCAGGGACATG GAGTCCGAC'] | 5269 | ['CCATTCTCCATT CCARCAACACC'] | 5479 | ['CCATTCTCCATT CCARCAACACC'] |
| NM_000275.2 (OCA2):c.1465A>G (p.Asn489Asp) | 4948 | OCA2 | 5093 | ['TGCCACTGCCATCG GGGACCCTCCARAT GTCATTATTGTTTCC AACCAAGA'] | 5270 | ['CCATCGGGGACC CTCCARATGTC'] | 5480 | ['CCATCGGGGACC CTCCARATGTC'] |
| NM_001127255.1 (NLRP7):c.2738A>G (p.Asn913Ser) | −1 | — | 5094 | ['CTCACAAACCTGG ACTTGAGTATCARC CAGATAGCTCGTGG ATTGTGGATT'] | 5271 | ['CCTGGACTTGAG TATCARCCAGA'] | 5481 | ['CCTGGACTTGAG TATCARCCAGA'] |
| NM_152783.4 (D2HGDH):c.1315A>G (p.Asn439Asp) | 728294 | D2HGDH | 5095 | ['TGCCCTTGTCCCTC CAGGAGATGGTRAC CTGCACCTCAATGT GACGGCGA'] | 5272 | ['CCTCCAGGAGAT GGTRACCTGCA'] | 5482-5483 | ['CCCTCCAGGAGA TGGTRACCTGC', 'CCTCCAGGAGAT GGTRACCTGCA'] |
| NM_022132.4 (MCCC2):c.1309A>G (p.Ile437Val) | 64087 | MCCC2 | 5096 | ['TGTGGCCTGTGCCC AAGTGCCTAAGDTA ACCCTCATCATTGG GGGCTCCTA'] | 5273 | ['CCCAAGTGCCTA AGDTAACCCTC'] | 5484 | ['CCCAAGTGCCTA AGDTAACCCTC'] |
| NM_000022.2 (ADA):c.219-2A>G | 100 | ADA | 5097 | ['TTCCCAACCCCTTT CTTCCCTTCCCRGGG GCTGCCGGGAGGCT ATCAAAAG'] | 5274 | ['CCCCTTTCTTCCC TTCCCRGGGG'] | 5485-5487 | ['CCCCTTTCTTCCC TTCCCRGGGG', 'CCCTTTCTTCCCT TCCCRGGGGC', 'CCTTTCTTCCCTT CCCRGGGGCT'] |
| NM_017780.3 (CHD7):c.3082A>G (p.Ile1028Val) | 55636 | CHD7 | 5098 | ['TTTAGTAATTGCCC CATTGTCCACARTC CCCAACTGGGAAAG GGAATTCCG'] | 5275 | ['CCCCATTGTCCA CARTCCCCAAC'] | 5488 | ['CCCCATTGTCCA CARTCCCCAAC'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000483.4 (APOC2):c.1A>G (p.MetlVal) | −1 | — | 5099 | ['TCAATGTTCCAGGT CTCTGGACACTRTG GGCACACGACTCCT CCCAGCTCT'] | 5276 | ['CCAGGTCTCTGG ACACTRTGGGC'] | 5489 | ['CCAGGTCTCTGG ACACTRTGGGC'] |
| NM_000391.3 (TPP1):c.887-10A>G | 1200 | TPP1 | 5100 | ['TGTCCCTCATGCCG GCCTGGATTTTYTTT TTTTTTTTTTTGAG GGATGGG'] | 5277 | ['CCGGCCTGGATT TTYTTTTTTTT'] | 5490 | ['CCGGCCTGGATT TTYTTTTTTTT'] |
| NM_017890.4 (VPS13B):c.8978A>G (p.Asn2993Ser) | 157680 | VPS13B | 5101 | ['CTTCTGCCCTGGGC CCTGCTTATCARTG AATCCAAATGGGAC CTCTGGCTA'] | 5278 | ['CCTGGGCCCTGC TTATCARTGAA'] | 5491 | ['CCTGGGCCCTGC TTATCARTGAA'] |
| NM_000226.3 (KRT9):c.482A>G (p.Asn161Ser) | 3857 | KRT9 | 5102 | ['GAGAAGAGCACCA TGCAGGAACTCADT TCTCGGCTGGCCTCT TACTTGGAT'] | 5279 | ['CCATGCAGGAAC TCADTTCTCGG'] | 5492 | ['CCATGCAGGAAC TCADTTCTCGG'] |
| NM_000529.2 (MC2R):c.761A>G (p.Tyr254Cys) | 4158 | MC2R | 5103 | ['CCAAGTAACCCCT ACTGCGCCTGCTRC ATGTCTCTCTTCCAG GTGAACGGC'] | 5280- 5281 | ['CCCCTACTGCGCC TGCTRCATGTC', 'CCTACTGCGCCTG CTRCATGTCT'] | 5493- 5495 | ['CCCCTACTGCGC CTGCTRCATGT', 'CCCTACTGCGCCT GCTRCATGTC', 'CCTACTGCGCCTG CTRCATGTCT'] |
| NM_005957.4 (MTHFR):c.971A>G (p.Asn324Ser) | 4524 | MTHFR | 5104 | ['CCAGGCCTCCACTT CTACACCCTCARCC GCGAGATGGCTACC ACAGAGGTG'] | 5282 | ['CCACTTCTACAC CCTCARCCGCG'] | 5496 | ['CCACTTCTACAC CCTCARCCGCG'] |
| NM_000403.3 (GALE):c.101A>G (p.Asn34Ser) | 2582 | GALE | 5105 | ['GGCTACTTGCCTGT GGTCATCGATARCT TCCATAATGCCTTCC GTGGTGAG'] | 5283 | ['CCTGTGGTCATC GATARCTTCCA'] | 5497 | ['CCTGTGGTCATC GATARCTTCCA'] |
| NM_000356.3 (TCOF1):c.149A>G (p.Tyr50Cys) | 6949 | TCOF1 | 5106 | ['CAGCCCGTAACCC TTCTGGACATCTRTA CACACTGGCAACAG TAAGTGGTG'] | 5284- 5285 | ['CCCTTCTGGACA TCTRTACACAC', 'CCTTCTGGACATC TRTACACACT'] | 5498- 5499 | ['CCCTTCTGGACA TCTRTACACAC', 'CCTTCTGGACATC TRTACACACT'] |
| NM_012464.4 (TLL1):c.1885A>G (p.Ile629Val) | 7092 | TLL1 | 5107 | ['ACTTCTTACCAAAC TTAACGGCACCRTA ACCACCCCTGGCTG GCCCAAGGA'] | 5286 | ['CCAAACTTAACG GCACCRTAACC'] | 5500 | ['CCAAACTTAACG GCACCRTAACC'] |
| NM_000112.3 (SLC26A2):c.1273A>G (p.Asn425Asp) | 1836 | SLC26A2 | 5108 | ['GGAAATGTATGCC ATTGGCTTTTGTRAT ATCATCCCTTCCTTC TTCCACTG'] | 5287 | ['CCATTGGCTTTT GTRATATCATC'] | 5501 | ['CCATTGGCTTTT GTRATATCATC'] |
| NM_000157.3 (GBA):c.680A>G (p.Asn227Ser) | 2629 | GBA | 5109 | ['ACATCACCCACTTG GCTCAAGACCARTG GAGCGGTGAATGGG AAGGGGTCA'] | 5288 | ['CCACTTGGCTCA AGACCARTGGA'] | 5502 | ['CCACTTGGCTCA AGACCARTGGA'] |
| NM_175073.2 (APTX):c.602A>G (p.His201Arg) | 54840 | APTX | 5110 | ['GATAAATACCCAA AGGCCCGTTACCRT TGGCTGGTCTTACC GTGGACCTCC'] | 5289- 5290 | ['CCCAAAGGCCCG TTACCRTTGGC', 'CCAAAGGCCCGT TACCRTTGGCT'] | 5503- 5504 | ['CCCAAAGGCCCG TTACCRTTGGC', 'CCAAAGGCCCGT TACCRTTGGCT'] |
| NM_020638.2 (FGF23):c.211A>G (p.Ser71Gly) | 8074 | FGF23 | 5111 | ['TGGCGCACCCCAT CAGACCATCTACRG TGAGTAGGGCTTCA GGCTGGGAAG'] | 5291 | ['CCCCATCAGACC ATCTACRGTGA'] | 5505- 5507 | ['CCCCATCAGACC ATCTACRGTGA', 'CCCATCAGACCA TCTACRGTGAG', 'CCATCAGACCAT CTACRGTGAGT'] |
| NM_021102.3 (SPINT2):c.488A>G (p.Tyr163Cys) | 10653 | SPINT2 | 5112 | ['AGGAACTCCTGCA ATAACTTCATCTRTG GAGGCTGCCGGGGC AATAAGAAC'] | 5292 | ['CCTGCAATAACT TCATCTRTGGA'] | 5508 | ['CCTGCAATAACT TCATCTRTGGA'] |
| NM_004795.3 (KL):c.578A>G (p.His193Arg) | 9365 | KL | 5113 | ['GTGCAGCCCGTGG TCACCCTGTACCRCT GGGACCTGCCCCAG CGCCTGCAG'] | 5293 | ['CCGTGGTCACCC TGTACCRCTGG'] | 5509 | ['CCGTGGTCACCC TGTACCRCTGG'] |
| NM_012193.3 (FZD4):c.766A>G (p.Ile256Val) | −1 | — | 5114 | ['GTTTTCCTACCCTG AGCGCCCCATCRTA TTTCTCAGTATGTGC TATAATAT'] | 5294- 5295 | ['CCCTGAGCGCCC CATCRTATTTC', 'CCTGAGCGCCCC ATCRTATTTCT'] | 5510- 5511 | ['CCCTGAGCGCCC CATCRTATTTC', 'CCTGAGCGCCCC ATCRTATTTCT'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_001099274.1 (TINF2):c.838A>G (p.Lys280Glu) | 26277 | TINF2 | 5115 | ['ATGGGCCTCCACT AGGGGAGGCCATDA GGAGCGCCCCACAG TCATGCTGTT'] | 5296 | ['CCACTAGGGGAG GCCATDAGGAG'] | 5512 | ['CCACTAGGGGAG GCCATDAGGAG'] |
| NM_005682.6 (ADGRG1):c.263A>G (p.Tyr88Cys) | 9289 | ADGRG1 | 5116 | ['TCCTTCCCTGACCC CAGGGGCCTCTRCC ACTTCTGCCTCTACT GGAACCGA'] | 5297 | ['CCCCAGGGGCCT CTRCCACTTCT'] | 5513 | ['CCCCAGGGGCCT CTRCCACTTCT'] |
| NM_000369.2 (TSHR):c.1856A>G (p.Asp619Gly) | 7253 | TSHR | 5117 | ['CCGCAGTACAACC CAGGGGACAAAGRT ACCAAAATTGCCAA GAGGATGGCT'] | 5298 | ['CCCAGGGGACAA AGRTACCAAAA'] | 5514 | ['CCCAGGGGACAA AGRTACCAAAA'] |
| NM_024009.2 (GJB3):c.497A>G (p.Asn166Ser) | 2707 | GJB3 | 5118 | ['ATGCCGCGCCTGG TGCAGTGTGCCADC GTGGCCCCCTGCCC CAACATCGTG'] | 5299 | ['CCTGGTGCAGTG TGCCADCGTGG'] | 5515 | ['CCTGGTGCAGTG TGCCADCGTGG'] |
| NM_003722.4 (TP63):c.697A>G (p.Lys233Glu) | 8626 | TP63 | 5119 | ['TATCCGCGCCATGC CTGTCTACAAARAA GCTGAGCACGTCAC GGAGGTGGT'] | 5300 | ['CCATGCCTGTCT ACAAARAAGCT'] | 5516 | ['CCATGCCTGTCT ACAAARAAGCT'] |
| NM_003494.3 (DYSF):c.3443-33A>G | 8291 | DYSF | 5120 | ['CAGCTCTTAACCAC TCCAGCCACTCRCT CTGGCACCTCTGTTT TTTCCCTT'] | 5301 | ['CCACTCCAGCCA CTCRCTCTGGC'] | 5517 | ['CCACTCCAGCCA CTCRCTCTGGC'] |
| NM_003494.3 (DYSF):c.1285-2A>G | 8291 | DYSF | 5121 | ['AACTTGTCCCCTCC CTGTGTCTTCTRGCT GTGCAGCAAGATCT TGGAGAAG'] | 5302 | ['CCCCTCCCTGTG TCTTCTRGCTG'] | 5518-5520 | ['CCCCTCCCTGTG TCTTCTRGCTG', 'CCCTCCCTGTGTC TTCTRGCTGT', 'CCTCCCTGTGTCT TCTRGCTGTG'] |
| NM_002408.3 (MGAT2):c.785A>G (p.His262Arg) | 4247 | MGAT2 | 5122 | ['CTTATACTTTTCCT AGAAGAGGATCRCT ACTTAGCCCCAGAC TTTTACCAT'] | 5303 | ['CCTAGAAGAGGA TCRCTACTTAG'] | 5521 | ['CCTAGAAGAGGA TCRCTACTTAG'] |
| NM_000492.3 (CFTR):c.2738A>G (p.Tyr913Cys) | 1080 | CFTR | 5123 | ['GTGATTATCACCA GCACCAGTTCGTRT TATGTGTTTTACATT TACGTGGGA'] | 5304 | ['CCAGCACCAGTT CGTRTTATGTG'] | 5522 | ['CCAGCACCAGTT CGTRTTATGTG'] |
| NM_001814.4 (CTSC):c.857A>G (p.Gln286Arg) | 1075 | CTSC | 5124 | ['TCTCAGACCCCAAT CCTAAGCCCTCRGG AGGTTGTGTCTTGTA GCCAGTAT'] | 5305 | ['CCCCAATCCTAA GCCCTCRGGAG'] | 5523-5525 | ['CCCCAATCCTAA GCCCTCRGGAG', 'CCCAATCCTAAG CCCTCRGGAGG', 'CCAATCCTAAGC CCTCRGGAGGT'] |
| NM_005144.4 (HR):c.-218A>G | 55806 | HR | 5125 | ['TCCGACCCCTCCAA CCTGCGGCCCTRGA GCGCCCCGCCGCC CCGGGGGAA'] | 5306 | ['CCTCCAACCTGC GGCCCTRGAGC'] | 5526-5527 | ['CCTCCAACCTGC GGCCCTRGAGC', 'CCAACCTGCGGC CCTRGAGCGCC'] |
| NM_018488.2 (TBX4):c.1592A>G (p.Gln531Arg) | 9496 | TBX4 | 5126 | ['TCCTTGTCCCGAGA ATCTTCCTTACRGTA CCATTCAGGAATGG GGACTGTG'] | 5307 | ['CCCGAGAATCTT CCTTACRGTAC'] | 5528-5529 | ['CCCGAGAATCTT CCTTACRGTAC', 'CCGAGAATCTTCC TTACRGTACC'] |
| NM_001089.2 (ABCA3):c.1702A>G (p.Asn568Asp) | 21 | ABCA3 | 5127 | ['ACAGATCACCGTC CTGCTGGGCCACRA CGGTGCCGGGAAGA CCACCACCCT'] | 5308 | ['CCGTCCTGCTGG GCCACRACGGT'] | 5530 | ['CCGTCCTGCTGG GCCACRACGGT'] |
| NM_000525.3 (KCNDJ11):c.776A>G (p.His259Arg) | 37671 | KCNJ1 | 5128 | ['CTGGTGGCCCCGCT GATCATCTACCRTG TCATTGATGCCAAC AGCCCACTC'] | 5309-5310 | ['CCCCGCTGATCA TCTACCRTGTC', 'CCCGCTGATCATC TACCRTGTCA'] | 5531-5533 | ['CCCCGCTGATCA TCTACCRTGTC', 'CCCGCTGATCATC TACCRTGTCA', 'CCGCTGATCATCT ACCRTGTCAT'] |
| NM_005587.2 (MEF2A):c.788A>G (p.Asn263Ser) | 4205 | MEF2A | 5129 | ['TCTCCCCCTCCACC AGGTGGTGGTARTC TTGGAATGAACAGT AGGAAACCA'] | 5311 | ['CCACCAGGTGGT GGTARTCTTGG'] | 5534 | ['CCACCAGGTGGT GGTARTCTTGG'] |
| NM_000098.2 (CPT2):c.359A>G (p.Tyr120Cys) | 1376 | CPT2 | 5130 | ['TTTTTAGGACCCTG GTTTGATATGTRCCT ATCTGCTCGAGACT CCGTTGTT'] | 5312 | ['CCTGGTTTGATA TGTRCCTATCT'] | 5535-5536 | ['CCCTGGTTTGAT ATGTRCCTATC', 'CCTGGTTTGATAT GTRCCTATCT'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_178138.4 (LHX3):c.332A>G (p.Tyr111Cys) | 8022 | LHX3 | 5131 | ['GTGCGCCGCGCCC AGGACTTCGTGTRC CACCTGCACTGCTTT GCCTGCGTC'] | 5313- 5314 | ['CCCAGGACTTCG TGTRCCACCTG', 'CCAGGACTTCGT GTRCCACCTGC'] | 5537- 5538 | ['CCCAGGACTTCG TGTRCCACCTG', 'CCAGGACTTCGT GTRCCACCTGC'] |
| NM_005502.3 (ABCA1):c.2804A>G (p.Asn935Ser) | 19 | ABCA1 | 5132 | ['CAGATCACCTCCTT CCTGGGCCACARTG GAGCGGGGAAGAC GACCACCATG'] | 5315 | ['CCTCCTTCCTGG GCCACARTGGA'] | 5539- 5540 | ['CCTCCTTCCTGG GCCACARTGGA', 'CCTTCCTGGGCCA CARTGGAGCG'] |
| m.3260A>G | 4567 | MT-TL1 | 5133 | ['GATGGCAGAGCCC GGTAATCGCATARA ACTTAAAACTTTAC AGTCAGAGGT'] | 5316- 5317 | ['CCCGGTAATCGC ATARAACTTAA', 'CCGGTAATCGCA TARAACTTAAA'] | 5541- 5542 | ['CCCGGTAATCGC ATARAACTTAA', 'CCGGTAATCGCA TARAACTTAAA'] |
| m.4269A>G | 4565 | MT-TI | 5134 | ['GCATTCCCCCTCAA ACCTAAGAAATRTG TCTGATAAAAGAGT TACTTTGAT'] | 5318- 5319 | ['CCCTCAAACCTA AGAAATRTGTC', 'CCTCAAACCTAA GAAATRTGTCT'] | 5543- 5544 | ['CCCTCAAACCTA AGAAATRTGTC', 'CCTCAAACCTAA GAAATRTGTCT'] |
| m.14495A>G | 4541 | MT-ND6 | 5135 | ['TCCAAAGACAACC ATCATTCCCCCTRA ATAAATTAAAAAAA CTATTAAACC'] | 5320 | ['CCATCATTCCCC CTRAATAAATT'] | 5545 | ['CCATCATTCCCC CTRAATAAATT'] |
| NM_002764.3 (PRPS1):c.341A>G (p.Asn114Ser) | 5631 | PRPS1 | 5136 | ['CCAATCTCAGCCA AGCTTGTTGCAART ATGCTATCTGTAGC AGGTGCAGAT'] | 5321 | ['CCAAGCTTGTTG CAARTATGCTA'] | 5546 | ['CCAAGCTTGTTG CAARTATGCTA'] |
| NM_000054.4 (AVPR2):c.614A>G (p.Tyr205Cys) | 554 | AVPR2 | 5137 | ['GCGGAGCCCTGGG GCCGTCGCACCTRT GTCACCTGGATTGC CCTGATGGTG'] | 5322 | ['CCTGGGGCCGTC GCACCTRTGTC'] | 5547 | ['CCTGGGGCCGTC GCACCTRTGTC'] |
| NM_000033.3 (ABCD1):c.443A>G (p.Asn148Ser) | 215 | ABCD1 | 5138 | ['ATCGCCCTCCCTGC TACCTTCGTCARCA GTGCCATCCGTTAC CTGGAGGGC'] | 5323- 5324 | ['CCCTGCTACCTT CGTCARCAGTG', 'CCTGCTACCTTCG TCARCAGTGC'] | 5548- 5549 | ['CCCTGCTACCTT CGTCARCAGTG', 'CCTGCTACCTTCG TCARCAGTGC'] |
| NM_000061.2 (BTK):c.1082A>G (p.Tyr361Cys) | 695 | BTK | 5139 | ['AGCACCATCCCTG AGCTCATTAACTRC CATCAGCACAACTC TGCAGGTGAG'] | 5325- 5326 | ['CCCTGAGCTCAT TAACTRCCATC', 'CCTGAGCTCATTA ACTRCCATCA'] | 5550- 5551 | ['CCCTGAGCTCAT TAACTRCCATC', 'CCTGAGCTCATTA ACTRCCATCA'] |
| NM_003413.3 (ZIC3):c.1213A>G (p.Lys405Glu) | 7547 | ZIC3 | 5140 | ['CTACACGCACCCG AGCTCCTGCGCRA ACACATGAAGGTAA TTACCTCTTT'] | 5327 | ['CCCGAGCTCCCTG CGCRAACACAT'] | 5552- 5553 | ['CCCGAGCTCCCT GCGCRAACACA', 'CCGAGCTCCCTGC GCRAACACAT'] |
| NM_005448.2 (BMP15):c.704A>G (p.Tyr235Cys) | 9210 | BMP15 | 5141 | ['TTGGACATTGCCTT CTTGTTACTCTRTTT CAATGATACTCATA AAAGCATT'] | 5328 | ['CCTTCTTGTTACT CTRTTTCAAT'] | 5554 | ['CCTTCTTGTTACT CTRTTTCAAT'] |
| NM_001363.4 (DKC1):c.1069A>G (p.Thr357Ala) | 1736 | DKC1 | 5142 | ['ATTAATGACCACA GCGGTCATCTCTRC CTGCGACCATGGTA TAGTAGCCAA'] | 5329 | ['CCACAGCGGTCA TCTCTRCCTGC'] | 5555 | ['CCACAGCGGTCA TCTCTRCCTGC'] |
| NM_000481.3 (AMT):c.125A>G (p.His42Arg) | 275 | AMT | 5143 | ['CGCAGGACACCGC TCTATGACTTCCRCC TGGCCCACGGCGGG AAAATGGTG'] | 5330 | ['CCGCTCTATGAC TTCCRCCTGGC'] | 5556 | ['CCGCTCTATGAC TTCCRCCTGGC'] |
| NM_003361.3 (UMOD):c.383A>G (p.Asn128Ser) | 7369 | UMOD | 5144 | ['TGCCACGCCCTGG CCACATGTGTCART GTGGTGGGCAGCTA CTTGTGCGTA'] | 5331 | ['CCTGGCCACATG TGTCARTGTGG'] | 5557- 5558 | ['CCCTGGCCACAT GTGTCARTGTG', 'CCTGGCCACATGT GTCARTGTGG'] |
| NM_001382.3 (DPAGT1):c.509A>G (p.Tyr170Cys) | 1798 | DPAGT1 | 5145 | ['TCTCTCCCCGCAGG AATCCTGTACTRTGT CTACATGGGGCTGC TGGCAGTG'] | 5332 | ['CCGCAGGAATCC TGTACTRTGTC'] | 5559 | ['CCGCAGGAATCC TGTACTRTGTC'] |
| NM_001128177.1 (THRB):c.1324A>G (p.Met442Val) | 7068 | THRB | 5146 | ['CTGCCATGCCAGC CGCTTCCTGCACRT GAAGGTGGAATGCC CCACAGAACT'] | 5333 | ['CCAGCCGCTTCC TGCACRTGAAG'] | 5560 | ['CCAGCCGCTTCC TGCACRTGAAG'] |
| NM_000141.4 (FGFR2):c.874A>G (p.Lys292Glu) | 2263 | FGFR2 | 5147 | ['TGCCCAGCCCCAC ATCCAGTGGATCRA GCACGTGAAAAGA ACGGCAGTAA'] | 5334 | ['CCCACATCCAGT GGATCRAGCAC'] | 5561- 5563 | ['CCCCACATCCAG TGGATCRAGCA', 'CCCACATCCAGT GGATCRAGCAC', 'CCACATCCAGTG GATCRAGCACG'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000371.3 (TTR):c.401A>G (p.Tyr134Cys) | 7276 | TTR | 5148 | ['ACCATTGCCGCCCT GCTGAGCCCCTRCT CCTATTCCACCACG GCTGTCGTC'] | 5335-5337 | ['CCGCCCTGCTGA GCCCCTRCTCC', 'CCCTGCTGAGCCC CTRCTCCTAT', 'CCTGCTGAGCCCC TRCTCCTATT'] | 5564-5566 | ['CCGCCCTGCTGA GCCCCTRCTCC', 'CCCTGCTGAGCCC CTRCTCCTAT', 'CCTGCTGAGCCCC TRCTCCTATT'] |
| NM_000371.3 (TTR):c.379A>G (p.Ile127Val) | 7276 | TTR | 5149 | ['CGACTCCGGCCCC CGCCGCTACACCRT TGCCGCCCTGCTGA GCCCCTACTC'] | 5338 | ['CCCCCGCCGCTA CACCRTTGCCG'] | 5567-5569 | ['CCCCCGCCGCTA CACCRTTGCCG', 'CCCCGCCGCTAC ACCRTTGCCGC', 'CCCGCCGCTACA CCRTTGCCGCC'] |
| NM_000174.4 (GP9):c.182A>G (p.Asn61Ser) | 2815 | GP9 | 5150 | ['ACCCGCCACCTTCT GCTGGCCAACARCA GCCTTCAGTCCGTG CCCCCGGGA'] | 5339 | ['CCTTCTGCTGGC CAACARCAGCC'] | 5570 | ['CCTTCTGCTGGC CAACARCAGCC'] |
| NM_000222.2 (KIT):c.1924A>G (p.Lys642Glu) | 3815 | KIT | 5151 | ['ACGGGAAGCCCTC ATGTCTGAACTCRA AGTCCTGAGTTACC TTGGTAATCA'] | 5340-5341 | ['CCCTCATGTCTG AACTCRAAGTC', 'CCTCATGTCTGAA CTCRAAGTCC'] | 5571-5572 | ['CCCTCATGTCTG AACTCRAAGTC', 'CCTCATGTCTGAA CTCRAAGTCC'] |
| NM_000530.6 (MPZ):c.242A>G (p.His81Arg) | 4359 | MPZ | 5152 | ['TCCCCTCATTCCTC ATAGATCTTCCRCT ATGCCAAGGGACAA CCCTACATT'] | 5342 | ['CCTCATAGATCT TCCRCTATGCC'] | 5573 | ['CCTCATAGATCT TCCRCTATGCC'] |
| NM_000233.3 (LHCGR):c.1733A>G (p.Asp578Gly) | -1 | — | 5153 | ['AAAATGGCAATCC TCATCTTCACCGRTT TCACCTGCATGGCA CCTATCTCT'] | 5343 | ['CCTCATCTTCAC CGRTTTCACCT'] | 5574 | ['CCTCATCTTCAC CGRTTTCACCT'] |
| NM_000421.3 (KRT10):c.1374-2A>G | -1 | — | 5154 | ['CCGCCGCGTCCGC CGCCTCCGGAACYA AACGGGGTGAGGTC ACATTCGGTT'] | 5344 | ['CCGCCGCCTCCG GAACYAAACGG'] | 5575 | ['CCGCCGCCTCCG GAACYAAACGG'] |
| NM_000422.2 (KRT17):c.274A>G (p.Asn92Asp) | 3872 | KRT17 | 5155 | ['TGAGAAGGCCACC ATGCAGAACCTCVA TGACCGCCTGGCCT CCTACCTGGA'] | 5345 | ['CCACCATGCAGA ACCTCVATGAC'] | 5576-5577 | ['CCACCATGCAGA ACCTCVATGAC', 'CCATGCAGAACC TCVATGACCGC'] |
| NM_000422.2 (KRT17):c.275A>G (p.Asn92Ser) | 3872 | KRT17 | 5156 | ['GAGAAGGCCACCA TGCAGAACCTCART GACCGCCTGGCCTC CTACCTGGAC'] | 5346 | ['CCACCATGCAGA ACCTCARTGAC'] | 5578-5579 | ['CCACCATGCAGA ACCTCARTGAC', 'CCATGCAGAACC TCARTGACCGC'] |
| NM_000823.3 (GHRHR):c.985A>G (p.Lys329Glu) | 2692 | GHRHR | 5157 | ['TTGTCTTTCCTGCA GGCGTCTCTCCRAG TCGACACTTTTCCTG ATCCCACT'] | 5347 | ['CCTGCAGGCGTC TCTCCRAGTCG'] | 5580 | ['CCTGCAGGCGTC TCTCCRAGTCG'] |
| NM_000407.4 (GP1BB):c.338A>G (p.Tyr113Cys) | -1 | — | 5158 | ['GCCGGCCGCCCCG AGCGTGCGCCCTDC CGCGACCTGCGTTG CGTGGCGCCC'] | 5348-5349 | ['CCCCGAGCGTGC GCCCTDCCGCG', 'CCCGAGCGTGCG CCCTDCCGCGA'] | 5581-5583 | ['CCCCGAGCGTGC GCCCTDCCGCG', 'CCCGAGCGTGCG CCCTDCCGCGA', 'CCGAGCGTGCGC CCTDCCGCGAC'] |
| NM_001146040.1 (GLRA1):c.920A>G (p.Tyr307Cys) | 2741 | GLRA1 | 5159 | ['CCTCCACCCCCACT CTAGGTGTCCTVTGT GAAAGCCATTGACA TTTGGATG'] | 5350-5351 | ['CCCCACTCTAGG TGTCCTVTGTG', 'CCCACTCTAGGTG TCCTVTGTGA'] | 5584-5586 | ['CCCCACTCTAGG TGTCCTVTGTG', 'CCCACTCTAGGTG TCCTVTGTGA', 'CCACTCTAGGTGT CCTVTGTGAA'] |
| NM_182925.4 (FLT4):c.3104A>G (p.His1035Arg) | 2324 | FLT4 | 5160 | ['CGCCTCCCCGCACC CCAGTGCATCCRCA GAGACCTGGCTGCT CGGAACATT'] | 5352 | ['CCGCACCCCAGT GCATCCRCAGA'] | 5587 | ['CCGCACCCCAGT GCATCCRCAGA'] |
| NM_212482.1 (FN1):c.2918A>G (p.Tyr973Cys) | 2335 | FN1 | 5161 | ['ACCGGGCTGTCCC CTGGGGTCACCTRT TACTTCAAAGTCTTT GCAGTGAGC'] | 5353-5354 | ['CCCCTGGGGTCA CCTRTTACTTC', 'CCCTGGGGTCAC CTRTTACTTCA'] | 5588-5589 | ['CCCCTGGGGTCA CCTRTTACTTC', 'CCCTGGGGTCAC CTRTTACTTCA'] |
| NM_000121.3 (EPOR):c.1460A>G (p.Asn487Ser) | 2057 | EPOR | 5162 | ['GGCTTATCCGATG GCCCCTACTCCARC CCTTATGAGAACAG CCTTATCCCA'] | 5355 | ['CCGATGGCCCCT ACTCCARCCCT'] | 5590 | ['CCGATGGCCCCT ACTCCARCCCT'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_001735.2 (C5):c.1115A>G (p.Lys372Arg) | 727 | C5 | 5163 | ['CGTCTACCCCCTCA CCCAATCTACCYTG ATGGGATATGGAAT CCCAGGCTT'] | 5356-5357 | ['CCCCTCACCCAA TCTACCYTGAT', 'CCCTCACCCAATC TACCYTGATG'] | 5591-5593 | ['CCCCTCACCCAA TCTACCYTGAT', 'CCCTCACCCAATC TACCYTGATG', 'CCTCACCCAATCT ACCYTGATGG'] |
| NM_001844.4 (COL2A1):c.4172A>G (p.Tyr1391Cys) | 1280 | COL2A1 | 5164 | ['ACGGAAGGCTCCC AGAACATCACCTRC CACTGCAAGAACAG CATTGCCTAT'] | 5358-5359 | ['CCCAGAACATCA CCTRCCACTGC', 'CCAGAACATCAC CTRCCACTGCA'] | 5594-5595 | ['CCCAGAACATCA CCTRCCACTGC', 'CCAGAACATCAC CTRCCACTGCA'] |
| NM_001904.3 (CTNNB1):c.121A>G (p.Thr41Ala) | 1499 | CTNNB1 | 5165 | ['CTCTGGAATCCATT CTGGTGCCACTNCC ACAGCTCCTTCTCTG AGTGGTAA'] | 5360 | ['CCATTCTGGTGC CACTNCCACAG'] | 5596 | ['CCATTCTGGTGC CACTNCCACAG'] |
| NM_000040.1 (APOC3):c.280A>G (p.Thr94Ala) | 345 | APOC3 | 5166 | ['GGATTTGGACCCT GAGGTCAGACCARC TTCAGCCGTGGCTG CCTGAGACCT'] | 5361-5362 | ['CCCTGAGGTCAG ACCARCTTCAG', 'CCTGAGGTCAGA CCARCTTCAGC'] | 5597-5598 | ['CCCTGAGGTCAG ACCARCTTCAG', 'CCTGAGGTCAGA CCARCTTCAGC'] |
| NM_000488.3 (SERPINC1):c.655A>G (p.Asn219Asp) | 462 | SERPINC1 | 5167 | ['TGCAGAGCAATCC AGAGCGGCCATCRA CAAATGGGTGTCCA ATAAGACCGA'] | 5363 | ['CCAGAGCGGCCA TCRACAAATGG'] | 5599 | ['CCAGAGCGGCCA TCRACAAATGG'] |
| NM_001085.4 (SERPINA3):c.1240A>G (p.Met414Val) | 12 | SERPINA3 | 5168 | ['TACAGACACCCAG AACATCTTCTTCRTG AGCAAAGTCACCAA TCCCAAGCA'] | 5364 | ['CCCAGAACATCT TCTTCRTGAGC'] | 5600-5601 | ['CCCAGAACATCT TCTTCRTGAGC', 'CCAGAACATCTTC TTCRTGAGCA'] |
| NM_001145.4 (ANG):c.121A>G (p.Lys41Glu) | -1 | — | 5169 | ['CTTCCTGACCCAGC ACTATGATGCCRAA CCACAGGGCCGGGA TGACAGATA'] | 5365 | ['CCAGCACTATGA TGCCRAACCAC'] | 5602-5603 | ['CCAGCACTATG ATGCCRAACCA', 'CCAGCACTATGA TGCCRAACCAC'] |
| NM_001100.3 (ACTA1):c.350A>G (p.Asn117Ser) | 58 | ACTA1 | 5170 | ['GAGGCCCCCCTCA ATCCCAAGGCCARC CGCGAGAAGATGAC CCAGATCATG'] | 5366 | ['CCTCAATCCCAA GGCCARCCGCG'] | 5604-5605 | ['CCCTCAATCCCA AGGCCARCCGC', 'CCTCAATCCCAA GGCCARCCGCG'] |
| NM_014053.3 (FLVCR1):c.361A>G (p.Asn121Asp) | 28982 | FLVCR1 | 5171 | ['GATCTTCAGCCTGT ACTCGCTGGTCRAC GCCTTTCAGTGGAT CCAGTACAG'] | 5367 | ['CCTGTACTCGCT GGTCRACGCCT'] | 5606 | ['CCTGTACTCGCT GGTCRACGCCT'] |
| NM_000334.4 (SCN4A):c.4078A>G (p.Met1360Val) | 6329 | SCN4A | 5172 | ['GAAGCAGGCCTTC GACATCACCATCRT GATCCTCATCTGCCT CAACATGGT'] | 5368 | ['CCTTCGACATCA CCATCRTGATC'] | 5607 | ['CCTTCGACATCA CCATCRTGATC'] |
| NM_004519.3 (KCNQ3):c.1403A>G (p.Asn468Ser) | 3786 | KCNQ3 | 5173 | ['GAACCAAAGCCTG TTGGCTTAAACART AAAGAGCGTTTCCG CACGGCCTTC'] | 5369 | ['CCTGTTGGCTTA AACARTAAAGA'] | 5608 | ['CCTGTTGGCTTA AACARTAAAGA'] |
| NM_007375.3 (TARDBP):c.800A>G (p.Asn267Ser) | 23435 | TARDBP | 5174 | ['AATGCCGAACCTA AGCACAATAGCART AGACAGTTAGAAAG AAGTGGAAGA'] | 5370 | ['CCTAAGCACAAT AGCARTAGACA'] | 5609 | ['CCTAAGCACAAT AGCARTAGACA'] |
| NM_032520.4 (GNPTG):c.6102A>G | 84572 | GNPTG | 5175 | ['TGCTGCCCCTGCAT CCTCCACCTTCRGG GCCATGAGAAGTTG CTGAGGACA'] | 5371 | ['CCTGCATCCTCC ACCTTCRGGGC'] | 5610 | ['CCTGCATCCTCC ACCTTCRGGGC'] |
| NM_000495.4 (COL4A5):c.466-2A>G | 1287 | COL4A5 | 5176 | ['AGAACTTCCATTG ATGGCTTCTTTTRGG GTGAACCAGGTAGT ATAATTATG'] | 5372 | ['CCATTGATGGCT TCTTTTRGGGT'] | 5611 | ['CCATTGATGGCT TCTTTTRGGGT'] |
| NM_000495.4 (COL4A5):c.1340-2A>G | 12875 | COMA | 5177 | ['TTGCTATCCTTTCT TTATCTTACTCRGGT GATGAGATATGTGA ACCAGGCC'] | 5373 | ['CCTTTCTTTATCT TACTCRGGTG'] | 5612 | ['CCTTTCTTTATCT TACTCRGGTG'] |
| NM_000060.3 (BTD):c.278A>G (p.Tyr93Cys) | 686 | BTD | 5178 | ['CTCATGAACCAGA ACCTTGACATCTRT GAACAGCAAGTGAT GACTGCAGCC'] | 5374 | ['CCAGAACCTTGA CATCTRTGAAC'] | 5613 | ['CCAGAACCTTGA CATCTRTGAAC'] |
| NM_000060.3 (BTD):c.641A>G (p.Asn214Ser) | 686 | BTD | 5179 | ['CTTGTTGACCGCTA CCGTAAACACARCC TCTACTTTGAGGCA GCATTCGAT'] | 5375 | ['CCGCTACCGTAA ACACARCCTCT'] | 5614 | ['CCGCTACCGTAA ACACARCCTCT'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000094.3 (COL7A1):c.425A>G (p.Lys142Arg) | 1294 | COL7A1 | 5180 | ['CAGCTGGCCCGAC CTGGTGTCCCCARG GTGATCCCTACCCC TACCATGCCT'] | 5376 | ['CCCGACCTGGTG TCCCCARGGTG'] | 5615-5616 | ['CCCGACCTGGTG TCCCCARGGTG', 'CCGACCTGGTGTC CCCARGGTGA'] |
| NM_005247.2 (FGF3):c.146A>G (p.Tyr49Cys) | 2248 | FGF3 | 5181 | ['GGGGCGCCCCGGC GCCGCAAGCTCTRC TGCGCCACGAAGTA CCACCTCCAG'] | 5377-5378 | ['CCCGGCGCCGCA AGCTCTRCTGC', 'CCGGCGCCGCAA GCTCTRCTGCG'] | 5617-5618 | ['CCCGGCGCCGCA AGCTCTRCTGC', 'CCGGCGCCGCAA GCTCTRCTGCG'] |
| NM_000313.3 (PROS1):c.701A>G (p.Tyr234Cys) | 5627 | PROS1 | 5182 | ['TGTGAATGCCCCG AAGGCTACAGATRT AATCTCAAATCAAA GTCTTGTGAA'] | 5379-5380 | ['CCCGAAGGCTAC AGATRTAATCT', 'CCGAAGGCTACA GATRTAATCTC'] | 5619-5621 | ['CCCCGAAGGCTA CAGATRTAATCT', 'CCCGAAGGCTAC AGATRTAATCT', 'CCGAAGGCTACA GATRTAATCTC'] |
| NM_004612.3 (TGFBR1):c.134A>G (p.Asn45Ser) | 7046 | TGFBR1 | 5183 | ['TTCTGCCACCTCTG TACAAAAGACARTT TTACTTGTGTGACA GATGGGCTC'] | 5381 | ['CCTCTGTACAAA AGACARTTTTA'] | 5622 | ['CCTCTGTACAAA AGACARTTTTA'] |
| m.608A>G | 4558 | MT-TF | 5184 | ['GTAGCTTACCTCCT CAAAGCAATACRCT GAAAATGTTTAGAC GGGCTCACA'] | 5382 | ['CCTCCTCAAAGC AATACRCTGAA'] | 5623-5624 | ['CCTCCTCAAAGC AATACRCTGAA', 'CCTCAAAGCAAT ACRCTGAAAAT'] |
| NM_001376.4 (DYNC1H1):c.2909A>G (p.Tyr970Cys) | 1778 | DYNC1H1 | 5185 | ['CTAAGAATAACCA ATCAGGTAATCTRC TTGAATCCACCAAT TGAAGAGTGC'] | 5383 | ['CCAATCAGGTAA TCTRCTTGAAT'] | 5625 | ['CCAATCAGGTAA TCTRCTTGAAT'] |
| NM_000459.4 (TEK):c.2690A>G (p.Tyr897Cys) | 7010 | TEK | 5186 | ['ATGCTCTCTTCCTT CCCTCCAGGCTVCT TGTACCTGGCCATT GAGTACGCG'] | 5384 | ['CCTTCCCTCCAG GCTVCTTGTAC'] | 5626 | ['CCTTCCCTCCAG GCTVCTTGTAC'] |
| NM_014191.3 (SCN8A):c.5302A>G (p.Asn1768Asp) | 6334 | SCN8A | 5187 | ['CATGTACATTGCCA TCATCCTGGAGRAC TTCAGTGTAGCCAC AGAGGAAAG'] | 5385 | ['CCATCATCCTGG AGRACTTCAGT'] | 5627 | ['CCATCATCCTGG AGRACTTCAGT'] |
| NM_002552.4 (ORC4):c.521A>G (p.Tyr174Cys) | 5000 | ORC4 | 5188 | ['CATCATAAAAACC AAACACTTCTCTRT AATCTTTTTGACATT TCTCAGTCT'] | 5386 | ['CCAAACACTTCT CTRTAATCTTT'] | 5628 | ['CCAAACACTTCT CTRTAATCTTT'] |
| NM_004813.2 (PEX16):c.992A>G (p.Tyr331Cys) | 9409 | PEX16 | 5189 | ['TACTTGCCCACCTG GCAGAAAATCTRCT TCTACAGTTGGGGC TGACAGACC'] | 5387-5388 | ['CCACCTGGCAGA AAATCTRCTTC', 'CCTGGCAGAAAA TCTRCTTCTAC'] | 5629-5630 | ['CCACCTGGCAGA AAATCTRCTTC', 'CCTGGCAGAAAA TCTRCTTCTAC'] |
| NM_016952.4 (CDON):c.2368A>G (p.Thr790Ala) | 50937 | CDON | 5190 | ['GTTTTTGTTTTCCC TCAAAGGTTCARCA TACAAATTTAGGGT CATTGCCAT'] | 5389 | ['CCCTCAAAGGTT CARCATACAAA'] | 5631 | ['CCCTCAAAGGTT CARCATACAAA'] |
| NM_016464.4 (TMEM138):c.287A>G (p.His96Arg) | 51524 | TMEM138 | 5191 | ['TACTTTGCCCTCAG CATCTCCCTTCRTGT CTGGGTCATGGTAA GAGTGGCA'] | 5390-5391 | ['CCCTCAGCATCT CCCTTCRTGTC', 'CCTCAGCATCTCC CTTCRTGTCT'] | 5632-5633 | ['CCCTCAGCATCT CCCTTCRTGTC', 'CCTCAGCATCTCC CTTCRTGTCT'] |
| NM_005022.3 (PFN1):c.350A>G (p.Glu117Gly) | 5216 | PFN1 | 5192 | ['GTTGATCAAACCA CCGTGGACACCTYC TTTGCCCATCAGCA GGACTAGCGC'] | 5392 | ['CCACCGTGGACA CCTYCTTTGCC'] | 5634 | ['CCACCGTGGACA CCTYCTTTGCC'] |
| NM_022787.3 (NMNAT1):c.817A>G (p.Asn273Asp) | 64802 | NMNAT1 | 5193 | ['GGTCATCCTGGCCC CTTTGCAGAGARAC ACTGCAGAAGCTAA GACATAGGA'] | 5393 | ['CCCCTTTGCAGA GARACACTGCA'] | 5635 | ['CCCCTTTGCAGA GARACACTGCA'] |
| NM_005340.6 (HINT1):c.152A>G (p.His51Arg) | 3094 | HINT1 | 5194 | ['GACATTTCCCCTCA AGCACCAACACRTT TTCTGGTGATACCC AAGAAACAT'] | 5394-5396 | ['CCCCTCAAGCAC CAACACRTTTT', 'CCCTCAAGCACC AACACRTTTTC', 'CCTCAAGCACCA ACACRTTTTCT'] | 5636-5638 | ['CCCCTCAAGCAC CAACACRTTTT', 'CCCTCAAGCACC AACACRTTTTC', 'CCTCAAGCACCA ACACRTTTTCT'] |
| NM_005211.3 (CSF1R):c.2320-2A>G | 1436 | CSF1R | 5195 | ['GACTAACCCTGCA GTGCTTTCCCTCRGT GCATCCACCGGGAC GTGGCAGCG'] | 5397 | ['CCTGCAGTGCTT TCCCTCRGTGC'] | 5639 | ['CCTGCAGTGCTT TCCCTCRGTGC'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_001039958.1 (MESP2):c.271A>G (p.Lys91Glu) | 145873 | MESP2 | 5196 | ['GCGGCAGAGCGCC AGCGAGCGGGAGRA ACTGCGCATGCGCA CGCTGGCCCG'] | 5398 | ['CCAGCGAGCGGG AGRAACTGCGC'] | 5640 | ['CCAGCGAGCGGG AGRAACTGCGC'] |
| NM_001099274.1 (TINF2):c.850A>G (p.Thr284Ala) | 26277 | TINF2 | 5197 | ['TAGGGGAGGCCAT AAGGAGCGCCCCRC AGTCATGCTGTTTCC CTTTAGGAA'] | 5399 | ['CCATAAGGAGCG CCCCRCAGTCA'] | 5641 | ['CCATAAGGAGCG CCCCRCAGTCA'] |
| NM_003863.3 (DPM2):c.68A>G (p.Tyr23Cys) | 8818 | DPM2 | 5198 | ['GCCGTTAGCCTGAT CATCTTCACCTRCTA CACCGCCTGGGTGA TTCTCTTG'] | 5400 | ['CCTGATCATCTT CACCTRCTACA'] | 5642 | ['CCTGATCATCTT CACCTRCTACA'] |
| NM_000530.6 (MPZ):c.347A>G (p.Asn116Ser) | 4359 | MPZ | 5199 | ['AAGGATGGCTCCA TTGTCATACACARC CTAGACTACAGTGA CAATGGCACG'] | 5401 | ['CCATTGTCATAC ACARCCTAGAC'] | 5643 | ['CCATTGTCATAC ACARCCTAGAC'] |
| NM_000138.4 (FBN1):c.3058A>G (p.Thr1020Ala) | 2200 | FBN1 | 5200 | ['ACCCGGATTTGCC ACAAAAGAAATTRC AAATGGAAAGCCTT TCTTCAAAGG'] | 5402 | ['CCACAAAAGAA ATTRCAAATGGA'] | 5644 | ['CCACAAAAGAA ATTRCAAATGGA'] |
| NM_000169.2 (GLA):c.1153A>G (p.Thr385Ala) | −1 | — | 5201 | ['GGCCTGTAATCCTG CCTGCTTCATCRCAC AGCTCCTCCCTGTG AAAAGGAA'] | 5403 | ['CCTGCCTGCTTC ATCRCACAGCT'] | 5645 | ['CCTGCCTGCTTC ATCRCACAGCT'] |
| NM_000257.3 (MYH7):c.2206A>G (p.Ile736Val) | 4625 | MYH7 | 5202 | ['AGCGGCCATCCCT GAGGGACAGTTCRT TGATAGCAGGAAGG GGGCAGAGAA'] | 5404 | ['CCCTGAGGGACA GTTCRTTGATA'] | 5646-5647 | ['CCCTGAGGGACA GTTCRTTGATA', 'CCTGAGGGACAG TTCRTTGATAG'] |
| NM_018972.2 (GDAP1):c.368A>G (p.His123Arg) | 54332 | GDAP1 | 5203 | ['AGCATGTATTACCC ACGGGTACAACRTT ACCGAGAGCTGCTT GACTCCTTG'] | 5405 | ['CCCACGGGTACA ACRTTACCGAG'] | 5648 | ['CCCACGGGTACA ACRTTACCGAG'] |
| NM_001946.3 (DUSP6):c.566A>G (p.Asn189Ser) | 1848 | DUSP6 | 5204 | ['ACTACCATCCGAG TCTGTTGCACTAYTG GGGTCTCGGTCAAG GTCAGACTC'] | 5406 | ['CCGAGTCTGTTG CACTAYTGGGG'] | 5649 | ['CCGAGTCTGTTG CACTAYTGGGG'] |
| NM_003867.3 (FGF17):c.560A>G (p.Asn187Ser) | 8822 | FGF17 | 5205 | ['TACCAAGGCCAGC TGCCCTTCCCCARCC ACGCCGAGAAGCAG AAGCAGTTC'] | 5407 | ['CCAGCTGCCCTT CCCCARCCACG'] | 5650 | ['CCAGCTGCCCTT CCCCARCCACG'] |
| NM_015560.2 (OPA1):c.1146A>G (p.Ile382Met) | 4976 | OPA1 | 5206 | ['TTTTTATTTTTCCT GAGTAGACCATRTC CTTAAATGTAAAAG GCCCTGGAC'] | 5408 | ['CCTGAGTAGACC ATRTCCTTAAA'] | 5651 | ['CCTGAGTAGACC ATRTCCTTAAA'] |
| NM_002972.3 (SBF1):c.1249A>G (p.Met417Val) | 6305 | SBF1 | 5207 | ['AAGGCCATGCCCT CCAGCACCTTCAYC AGGAAATCGTCCTC TACCAGCCCA'] | 5409 | ['CCCTCCAGCACC TTCAYCAGGAA'] | 5652-5653 | ['CCCTCCAGCACC TTCAYCAGGAA', 'CCTCCAGCACCTT CAYCAGGAAA'] |
| NM_006876.2 (B4GAT1):c.1168A>G (p.Asn390Asp) | 11041 | B4GAT1 | 5208 | ['GTTCCATCCCCAAA AGGAGGCTGAAAT CAGCACAATAAGAT CCTATATCG'] | 5410 | ['CCAAAAGGAGG CTGAARATCAGC'] | 5654-5656 | ['CCCCAAAAGGAG GCTGAARATCA', 'CCCAAAAGGAGG CTGAARATCAG', 'CCAAAAGGAGGC TGAARATCAGC'] |
| NM_000218.2 (KCNQ1):c.332A>G (p.Tyr111Cys) | 3784 | KCNQ1 | 5209 | ['CGCACCCACGTCC AGGGCCGCGTCTRC AACTTCCTCGAGCG TCCCACCGGC'] | 5411 | ['CCAGGGCCGCGT CTRCAACTTCC'] | 5657 | ['CCAGGGCCGCGT CTRCAACTTCC'] |
| NM_000492.3 (CFTR):c.1A>G (p.MetIVal) | 1080 | CFTR | 5210 | ['CAGGGACCCCAGC GCCCGAGAGACCRT GCAGAGGTCGCCTC TGGAAAAGGC'] | 5412 | ['CCAGCGCCCGAG AGACCRTGCAG'] | 5658-5659 | ['CCCAGCGCCCGA GAGACCRTGCA', 'CCAGCGCCCGAG AGACCRTGCAG'] |
| NM_007294.3 (BRCA1):c.122A>G (p.His41Arg) | 672 | BRCA1 | 5211 | ['GAACCTGTCTCCAC AAAGTGTGACCRCA TATTTTGCAAGTAA GTTTGAATG'] | 5413 | ['CCACAAAGTGTG ACCRCATATTT'] | 5660 | ['CCACAAAGTGTG ACCRCATATTT'] |
| NM_007294.3 (BRCA1):c.44852A>G | 672 | BRCA1 | 5212 | ['GTTTTCTCCTTCCA TTTATCTTTCTRGGT CATCCCCTTCTAAAT GCCCATC'] | 5414 | ['CCTTCCATTTATC TTTCTRGGTC'] | 5661-5662 | ['CCTTCCATTTATC TTTCTRGGTC', 'CCATTTATCTTTC TRGGTCATCC'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_014795.3 (ZEB2):c.3134A>G (p.His1045Arg) | 9839 | ZEB2 | 5213 | ['AAACACAAGCACC ACCTTATCGAGCRC TCAAGGCTTCACTC GGGCGAGAAG'] | 5415 | ['CCACCTTATCGA GCRCTCAAGGC'] | 5663 | ['CCACCTTATCGA GCRCTCAAGGC'] |
| NM_001287.5 (CLCN7):c.296A>G (p.Tyr99Cys) | 1186 | CLCN7 | 5214 | ['TGTCCCGGCCTGCA GAGCTTGGACTRTG ACAACAGTGAGAAC CAGCTGTTC'] | 5416 | ['CCTGCAGAGCTT GGACTRTGACA'] | 5664 | ['CCTGCAGAGCTT GGACTRTGACA'] |
| NM_080605.3 (B3GALT6):c.1A>G (p.MetlVal) | 126792 | B3GALT6 | 5215 | ['CGCCACGCCCGCC GCAGCAGCTTCAYG GCGCCCGCGCCGGG CCGGCGGCCC'] | 5417 | ['CCCGCCGCAGCA GCTTCAYGGCG'] | 5665-5667 | ['CCCGCCGCAGCA GCTTCAYGGCG', 'CCGCCGCAGCAG CTTCAYGGCGC', 'CCGCAGCAGCTT CAYGGCGCCCG'] |
| NM_000207.2 (1NS):c.*59A>G | −1 | — | 5216 | ['TCCTGCACCGAGA GAGATGGAATAARG CCCTTGAACCAGCC CTGCTGTGCC'] | 5418 | ['CCGAGAGAGATG GAATAARGCCC'] | 5668 | ['CCGAGAGAGATG GAATAARGCCC'] |
| NM_000784.3 (CYP27A1):c.1061A>G (p.Asp354Gly) | 1593 | CYP27A1 | 5217 | ['TGGGCCCTGTACC ACCTCTCAAAGGRC CCTGAGATCCAGGA GGCCTTGCAC'] | 5419 | ['CCACCTCTCAAA GGRCCCTGAGA'] | 5669 | ['CCACCTCTCAAA GGRCCCTGAGA'] |
| NM_000540.2 (RYRO:c.14572A>G (p.Asn4858Asp) | 6261 | RYR1 | 5218 | ['CTACCTGTACACCG TGGTGGCCTTCRAC TTCTTCCGCAAGTTC TACAACAA'] | 5420 | ['CCGTGGTGGCCT TCRACTTCTTC'] | 5670 | ['CCGTGGTGGCCT TCRACTTCTTC'] |
| NM_000238.3 (KCNH2):c.1478A>G (p.Tyr493Cys) | 3757 | KCNH2 | 5219 | ['CACCCCGGCCGCA TCGCCGTCCACTNC TTCAAGGGCTGGTT CCTCATCGAC'] | 5421 | ['CCGCATCGCCGT CCACTNCTTCA'] | 5671 | ['CCGCATCGCCGT CCACTNCTTCA'] |
| NM_000335.4 (SCN5A):c.688A>G (p.Ile230Val) | 6331 | SCN5A | 5220 | ['CCGAGTCCTCCGG GCCCTGAAAACTRT ATCAGTCATTTCAG GTGAAAATCA'] | 5422 | ['CCGGGCCCTGAA AACTRTATCAG'] | 5672 | ['CCGGGCCCTGAA AACTRTATCAG'] |
| NM_000169.2 (GLA):c.548-2A>G | −1 | — | 5221 | ['TATTTTACCCATTG TTTTCTCATACRGGT TATAAGCACATGTC CTTGGCCC'] | 5423 | ['CCCATTGTTTTCT CATACRGGTT'] | 5673-5674 | ['CCCATTGTTTTCT CATACRGGTT', 'CCATTGTTTTCTC ATACRGGTTA'] |
| NM_000146.3 (FTL):c.1A>G (p.MetlVal) | 2512 | FTL | 5222 | ['GTTAGCTCCTTCTT GCCAACCAACCRTG AGCTCCCAGATTCG TCAGAATTA'] | 5424 | ['CCTTCTTGCCAA CCAACCRTGAG'] | 5675 | ['CCTTCTTGCCAA CCAACCRTGAG'] |
| NM_000531.5 (OTC):c.1034A>G (p.Tyr345Cys) | 5009 | OTC | 5223 | ['GTCATGGTGTCCCT GCTGACAGATTRCT CACCTCAGCTCCAG AAGCCTAAA'] | 5425-5426 | ['CCCTGCTGACAG ATTRCTCACCT', 'CCTGCTGACAGA TTRCTCACCTC'] | 5676-5677 | ['CCCTGCTGACAG ATTRCTCACCT', 'CCTGCTGACAGA TTRCTCACCTC'] |
| NM_000531.5 (OTC):c.350A>G (p.His117Arg) | 5009 | OTC | 5224 | ['TGTTTTCTTACCAC ACAAGATATTCDTT TGGGTGTGAATGAA AGTCTCACG'] | 5427 | ['CCACACAAGATA TTCDTTTGGGT'] | 5678 | ['CCACACAAGATA TTCDTTTGGGT'] |
| NM_000531.5 (OTC):c.524A>G (p.Asp175Gly) | 5009 | OTC | 5225 | ['TACCATCCTATCCA GATCCTGGCTGDTT ACCTCACGCTCCAG GTTGGTTTA'] | 5428 | ['CCAGATCCTGGC TGDTTACCTCA'] | 5679 | ['CCAGATCCTGGC TGDTTACCTCA'] |
| NM_000531.5 (OTC):c.527A>G (p.Tyr176Cys) | 5009 | OTC | 5226 | ['CATCCTATCCAGAT CCTGGCTGATTRCCT CACGCTCCAGGTTG GTTTATTT'] | 5429 | ['CCAGATCCTGGC TGATTRCCTCA'] | 5680 | ['CCAGATCCTGGC TGATTRCCTCA'] |
| NM_000531.5 (OTC):c.542A>G (p.Glu181Gly) | 5009 | OTC | 5227 | ['TCTCCTTCATCCCG TGCCTTTAGGRAC ACTATAGCTCTG AAAGGTCTT'] | 5430 | ['CCGTGCCTTTTA GGRACACTATA'] | 5681-5682 | ['CCGTGCCTTTT AGGRACACTAT', 'CCGTGCCTTTTAG GRACACTATA'] |
| NM_024301.4 (FKRP):c.1A>G (p.MetlVal) | 79147 | FKRP | 5228 | ['CCAGCTAGCCCCA GACTTCGGCCCCRT GCGGCTCACCCGCT GCCAGGCTGC'] | 5431 | ['CCCCAGACTTCG GCCCCRTGCGG'] | 5683-5685 | ['CCCCAGACTTCG GCCCCRTGCGG', 'CCCAGACTTCGG CCCCRTGCGGC', 'CCAGACTTCGGC CCCRTGCGGCT'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_000321.2 (RBO:c.1927A>G (p.Lys643Glu) | 5925 | RB1 | 5229 | ['AGCCTTCCAGACC CAGAAGCCATTGRA ATCTACCTCTCTTTC ACTGTTTTA'] | 5432 | ['CCCAGAAGCCAT TGRAATCTACC'] | 5686 | ['CCCAGAAGCCAT TGRAATCTACC'] |
| NM_015713.4 (RRM2B):c.581A> G(p.Glu194Gly) | 50484 | RRM2B | 5230 | ['AAAAGATCCTGAG AAGAAAACTCCTYC TACAGCAGCAAAGG CCACCACTCT'] | 5433 | ['CCTGAGAAGAAA ACTCCTYCTAC'] | 5687 | ['CCTGAGAAGAAA ACTCCTYCTAC'] |
| NM_000219.5 (KCNE1):c.242A>G (p.Tyr81Cys) | 3753 | KCNE1 | 5231 | ['CACTCGAACGACC CATTCAACGTCTDC ATCGAGTCCGATGC CTGGCAAGAG'] | 5434 | ['CCCATTCAACGT CTDCATCGAGT'] | 5688 | ['CCCATTCAACGT CTDCATCGAGT'] |
| NM_003108.3 (SOX11):c.347A>G (p.Tyr116Cys) | 6664 | SOX11 | 5232 | ['AAGCACATGGCCG ACTACCCCGACTRC AAGTACCGGCCCCG GAAAAAGCCC'] | 5435 | ['CCGACTACCCCG ACTRCAAGTAC'] | 5689 | ['CCGACTACCCCG ACTRCAAGTAC'] |
| NM_002764.3 (PRPSO:c.343A>G (p.Met115Val) | 5631 | PRPS1 | 5233 | ['AATCTCAGCCAAG CTTGTTGCAAATRTG CTATCTGTAGCAGG TGCAGATCA'] | 5436 | ['CCAAGCTTGTTG CAAATRTGCTA'] | 5690 | ['CCAAGCTTGTTG CAAATRTGCTA'] |
| NM_000546.5 (TP53):c.1101-2A>G | 7157 | TP53 | 5234 | ['TCTCCTCCCTGCTT CTGTCTCCTACRGCC ACCTGAAGTCCAAA AAGGGTCA'] | 5437 | ['CCTGCTTCTGTCT CCTACRGCCA'] | 5691 | ['CCTGCTTCTGTCT CCTACRGCCA'] |
| NM_000166.5 (GJB1):c.580A>G (p.Met194Val) | 2705 | GJB1 | 5235 | ['CGAGAAAACCGTC TTCACCGTCTTCRTG CTAGCTGCCTCTGG CATCTGCAT'] | 5438 | ['CCGTCTTCACCG TCTTCRTGCTA'] | 5692 | ['CCGTCTTCACCG TCTTCRTGCTA'] |
| NM_003159.2 (CDKL5):c.449A>G (p.Lys150Arg) | 6792 | CDKL5 | 5236 | ['TTAATCAGCCACA ATGATGTCCTAARA CTGTGTGACTTTGGT AAGTTAAAA'] | 5439 | ['CCACAATGATGT CCTAARACTGT'] | 5693 | ['CCACAATGATGT CCTAARACTGT'] |
| NM_000053.3 (ATP7B):c.122A>G (p.Asn41Ser) | 540 | ATP7B | 5237 | ['ATCCAGACCACCTT CATAGCCAACAYTG TCAAAAGCAAAACT CTTCTTCAT'] | 5440 | ['CCACCTTCATAG CCAACAYTGTC'] | 5694-5695 | ['CCACCTTCATAG CCAACAYTGTC', 'CCTTCATAGCCAA CAYTGTCAAA'] |
| NM_006306.3 (SMC1A):c.3254A>G (p.Tyr1085Cys) | 8243 | SMC1A | 5238 | ['GTGGCTACCAACA TTGATGAGATCTRT AAGGCCCTGTCCCG CAATAGCAGT'] | 5441 | ['CCAACATTGATG AGATCTRTAAG'] | 5696 | ['CCAACATTGATG AGATCTRTAAG'] |
| NM_005154.4 (USP8):c.2150A>G (p.Tyr717Cys) | 9101 | USP8 | 5239 | ['GAACCTTCCAAAC TGAAGCGCTCCTDC TCCTCCCCAGATAT AACCCAGGCT'] | 5442 | ['CCAAACTGAAGC GCTCCTDCTCC'] | 5697 | ['CCAAACTGAAGC GCTCCTDCTCC'] |
| NM_000117.2 (EMD):c.266-2A>G | 2010 | EMD | 5240 | ['TCTGCTACCGCTGC CCCCCTTCCCARGG CTACAATGACGACT ACTATGAAG'] | 5443 | ['CCGCTGCCCCCC TTCCCARGGCT'] | 5698 | ['CCGCTGCCCCCC TTCCCARGGCT'] |
| NM_207352.3 (CYP4V2):c.1393A>G (p.Arg465Gly) | 285440 | CYP4V2 | 5241 | ['CTACGTGCCCTTCT CTGCTGGCCCCRGG AACTGTATAGGTTT GTATCCATC'] | 5444 | ['CCCTTCTCTGCT GGCCCCRGGAA'] | 5699-5700 | ['CCCTTCTCTGCT GGCCCCRGGAA', 'CCTTCTCTGCTGG CCCCRGGAAC'] |
| NM_000546.5 (TP53):c.709A>G (p.Met237Val) | 7157 | TP53 | 5242 | ['CTGTACCACCATCC ACTACAACTACRTG TGTAACAGTTCCTG CATGGGCGG'] | 5445 | ['CCATCCACTACA ACTACRTGTGT'] | 5701 | ['CCATCCACTACA ACTACRTGTGT'] |
| NM_016069.9 (PAM16):c.226A>G (p.Asn76Asp) | −1 | — | 5243 | ['CTCACCCGTCCCCT CTCCTCTGCAGRAC TATGAACACTTATTT AAGGTGAA'] | 5446 | ['CCTCTCCTCTGC AGRACTATGAA'] | 5702-5704 | ['CCCCTCTCCTCT GCAGRACTATG', 'CCCTCTCCTCTGC AGRACTATGA', 'CCTCTCCTCTGCA GRACTATGAA'] |
| NM_006785.3 (MALT1):c.1019-2A>G | 10892 | MALT1 | 5244 | ['AACACCCCCTTTCT TTTTTTTCAARGCG AAGGACAAGGTTGC CCTTTTGA'] | 5447 | ['CCTTTCTTTTTTT TCAARGCGA'] | 5705 | ['CCTTTCTTTTTTT TCAARGCGA'] |
| NM_004771.3 (MMP20):c.611A>G (p.His204Arg) | 9313 | MMP20 | 5245 | ['GGAGAAGGCCTGG GAGGAGATACACRT TTCGACAATGCTGA GAAGTGGACT'] | 5448 | ['CCTGGGAGGAGA TACACRTTTCG'] | 5706 | ['CCTGGGAGGAGA TACACRTTTCG'] |

TABLE 3-continued

A to G with NGG PAM. Table 2 shows a list of A to G mutations that may be corrected using any of the base editors provided herein. GRNAs and gRNAall indicate the protospacer and PAM sequence, where the PAM sequence is the last 3 nucleotides of each of the sequences in GRNAs and gRNAall.

| Name | Gene ID | Gene Symbol | SEQ ID NO: | Flanks | SEQ ID NO: | GRNAs | SEQ ID NO: | gRNAall |
|---|---|---|---|---|---|---|---|---|
| NM_003159.2 (CDKL5):c.458A>G (p.Asp153Gly) | 6792 | CDKL5 | 5246 | ['CACAATGATGTCCT AAAACTGTGTGRCT TTGGTAAGTTAAAA AGAAATTAA'] | 5449 | ['CCTAAAACTGTG TGRCTTTGGTA'] | 5707 | ['CCTAAAACTGTG TGRCTTTGGTA'] |
| NM_001204830.1 (LIPT1):c.535A>G (p.Thr179Ala) | −1 | — | 5247 | ['CCGGACTACTGCCT ATCACCATTGCRCTT TATTATGTAGTACTG ATGGGAC'] | 5450 | ['CCTATCACCATT GCRCTTTATTA'] | 5708 | ['CCTATCACCATT GCRCTTTATTA'] |
| NM_000921.4 (PDE3A):c.1333A>G (p.Thr445Ala) | 5139 | PDE3A | 5248 | ['AGTTTCTTCCACTT GGACCACCACCRCC TCGGCCACAGGTCT ACCCACCTT'] | 5451 | ['CCACTTGGACCA CCACCRCCTCG'] | 5709 | ['CCACTTGGACCA CCACCRCCTCG'] |
| NM_000182.4 (HADHA):c.9192A>G | 3030 | HADHA | 5249 | ['TTGCTCAATTCCAG TCTTTACCACCYAA AAAACATATAAAGC ACTTGCTCA'] | 5452 | ['CCAGTCTTTACC ACCYAAAAAAC'] | 5710 | ['CCAGTCTTTACC ACCYAAAAAAC'] |
| NM_000169.2 (GLA):c.620A>G (p.Tyr207Cys) | −1 | — | 5250 | ['GTGTACTCCTGTGA GTGGCCTCTTTRTAT GTGGCCCTTTCAAA AGGTGAGA'] | 5453 | ['CCTGTGAGTGGC CTCTTTRTATG'] | 5711 | ['CCTGTGAGTGGC CTCTTTRTATG'] |
| NM_000238.3 (KCNH2):c.2582A>G (p.Asn861Ser) | 3757 | KCNH2 | 5251 | ['TGGTCCAGCCTGG AGATCACCTTCANC CTGCGAGATGTGAG TTGGCTGCCC'] | 5454 | ['CCTGGAGATCAC CTTCANCCTGC'] | 5712 | ['CCTGGAGATCAC CTTCANCCTGC'] |
| NM_000218.2 (KCNQ1):c.605A>G (p.Asp202Gly) | 3784 | KCNQ1 | 5252 | ['GCTCCCCCTCTCCT GCACTCCACAGRCC TCATCGTGGTCGTG GCCTCCATG'] | 5455 | ['CCTGCACTCCAC AGRCCTCATCG'] | 5713 | ['CCTGCACTCCAC AGRCCTCATCG'] |
| NM_012203.1 (GRHPR):c.934A>G (p.Asn312Asp) | 9380 | GRHPR | 5253 | ['CACCATGTCCTTGT TGGCAGCTAACRAC TTGCTGGCTGGCCT GAGAGGGGA'] | 5456 | ['CCTTGTTGGCAG CTAACRACTTG'] | 5714 | ['CCTTGTTGGCAG CTAACRACTTG'] |
| NM_021007.2 (SCN2A):c.3872A>G | 6326 | SCN2A | 5254 | ['ACTTTGTCTTCCTT GACGATATTCTRCTT TATTCAATATGCTCA TTATGTG'] | 5457 | ['CCTTGACGATAT TCTRCTTTATT'] | 5715 | ['CCTTGACGATAT TCTRCTTTATT'] |
| NM_002693.2 (POLG):c.2840A>G (p.Lys947Arg) | 8542 | POLG | 5255 | ['GTGGGCATCAGCC GTGAGCATGCCARA ATCTTCAACTACGG CCGCATCTAT'] | 5458 | ['CCGTGAGCATGC CARAATCTTCA'] | 5716 | ['CCGTGAGCATGC CARAATCTTCA'] |
| NM_020533.2 (MCOLN1):c.1406A>G (p.Asn469Ser) | 57192 | MCOLN1 | 5256 | ['TCTGAGTGCCTGTT CTCGCTCATCARTG GGGACGACATGTTT GTGACGTTC'] | 5459 | ['CCTGTTCTCGCT CATCARTGGGG'] | 5717 | ['CCTGTTCTCGCT CATCARTGGGG'] |
| NM_000069.2 (CACNA1S):c.3526-2A>G | 779 | CACNA1S | 5257 | ['TCGCTTTCCCATCC TTTTCCTTCCCRGGG'] | 5460 | ['CCCATCCTTTTCC TTCCCRGGGC'] ['CTACTTTGGAGACC CCTGGAAT'] | 5718- 5719 | ['CCCATCCTTTTCC TTCCCRGGGC', 'CCATCCTTTTCCT TCCCRGGGCT'] |
| NM_017662.4 (TRPM6):c.3173A>G (p.Tyr1058Cys) | 140803 | TRPM6 | 5258 | ['CAAGCTGTCTACCT CTTCGTGCAATRTAT CATCATGGTGAACC TGTTGATT'] | 5461 | ['CCTCTTCGTGCA ATRTATCATCA'] | 5720 | ['CCTCTTCGTGCA ATRTATCATCA'] |
| NM_006642.3 (SDCCAG8):c.2212A>G | 10806 | SDCCAG8 | 5259 | ['AATAAACCCTCTG CTTTTGCTCTATRGT TAATCAGCTCAAAG ATTTGTTGC'] | 5462 | ['CCTCTGCTTTTGC TCTATRGTTA'] | 5721 | ['CCTCTGCTTTTGC TCTATRGTTA'] |
| NM_003560.2 (PLA2G6):c.1349-2A>G | 8398 | PLA2G6 | 5260 | ['CAGCATGCCCTGCT CTGTGCCTCACRGA ACTACAGGATCTCA TGCACATCT'] | 5463 | ['CCCTGCTCTGTG CCTCACRGAAC'] | 5722- 5723 | ['CCCTGCTCTGTG CCTCACRGAAC', 'CCTGCTCTGTGCC TCACRGAACT'] |

Example 6

Next Generation C to T Editors

Other families of cytidine deaminases as alternatives to base editor 3 (BE3) constructs were examined. The different C to T editors were developed to have a narrow or different editing window, alternate sequence specificity to expand targetable substrates, and to have higher activity.

Using the methods described in Example 4, the pmCDA1 (cytidine deaminase 1 from *Petromyzon marinus*) activity at the HeK-3 site is evaluated (FIG. 42). The pmCDA1-nCas9-UGI-NLS (nCas9 indicates the Cas9 nickase described herein) construct is active on some sites (e.g., the C bases on the complementary strand at position 9, 5, 4, and 3) that are not accessible with rAPOBEC1 (BE3).

The pmCDA1 activity at the HeK-2 site is given in FIG. 43. The pmCDA1-XTEN-nCas9-UGI-NLS construct is active on sites adjacent to "G," while rAPOBEC1 analog (BE3 construct) has low activity on "C"s that are adjacent to "G"s, e.g., the C base at position 11 on the complementary strand.

The percent of total sequencing reads with target C converted to T (FIG. 44), C converted to A (FIG. 45), and C converted to G (FIG. 46) are shown for CDA and APOBEC1 (the BE3 construct).

The huAPOBEC3G activity at the HeK-2 site is shown in FIG. 47. Two constructs were used: huAPOBEC3G-XTEN-nCas9-UGI-NLS and huAPOBEC3G*(D316R_D317R)-XTEN-nCas9-UGI-NLS. The huAPOBEC3G-XTEN-nCas9-UGI-NLS construct has different sequence specificity than rAPOBEC1 (BE3), as shown in FIG. 47, the editing window appears narrow, as indicated by APOBEC3G's descreased activity at position 4 compared to APOBEC1. Mutations made in huAPOBEC3G (D316R and D317R) increased ssDNA binding and resulted in an observable effect on expanding the sites which were edited (compare APOBEC3G with APOBEC3G_RR in FIG. 47). Mutations were chosen based on APOBEC3G crystal structure, see: Holden et al., Crystal structure of the anti-viral APOBEC3G catalytic domain and functional implication. *Nature.* (2008); 121-4, the entire contents of which are incorporated herein by reference.

Example 7 pmCDA1/huAPOBEC3G/rAPOBEC1 Work in *E. coli*

LacZ selection optimization for the A to I conversion was performed using a bacterial strain with lacZ encoded on the F plasmid. A critical glutamic acid residue was mutated (e.g., GAG to GGG, Glu to Gly mutation) so that G to A by a cytidine deaminase would restore lacZ activity (FIG. 48). Strain CC102 was selected for the selection assay. APOBEC1 and CDA constructs were used in a selection assay to optimize G to A conversion.

To evaluate the effect of copy number of the plasmids encoding the deaminase constructs on lacZ reversion frequency, the CDA and APOBEC1 deaminases were cloned into 4 plasmids with different replication origins (hence different copy numbers), SC101, CloDF3, RSF1030, and PUC (copy number: PUC>RSF1030>CloDF3>SC101) and placed under an inducible promoter. The plasmids were individually transformed into *E. coli* cells harboring F plasmid containing the mutated LacZ gene. The expression of the deaminases were induced and LacZ activity was detected for each construct (FIG. 49). As shown in FIG. 49, CDA exhibited significantly higher activity than APOBEC1 in all instances, regardless of the plasmid copy number the deaminases were cloned in. Further, In terms of the copy number, the deaminase activity was positively correlated with the copy number of the plasmid they are cloned in, i.e., PUC>CloDF3>SC101.

LacZ reversions were confirmed by sequencing of the genomic DNA at the lacZ locus. To obtain the genomic DNA containing the corrected LacZ gene, cells were grown media containing X-gal, where cells having LacZ activity form blue colonies. Blue colonies were selected and grown in minimal media containing lactose. The cells were spun down, washed, and re-plated on minimal media plates (lactose). The blue colony at the highest dilution was then selected, and its genomic DNA was sequenced at the lacZ locus (FIG. 50).

Figure 53:
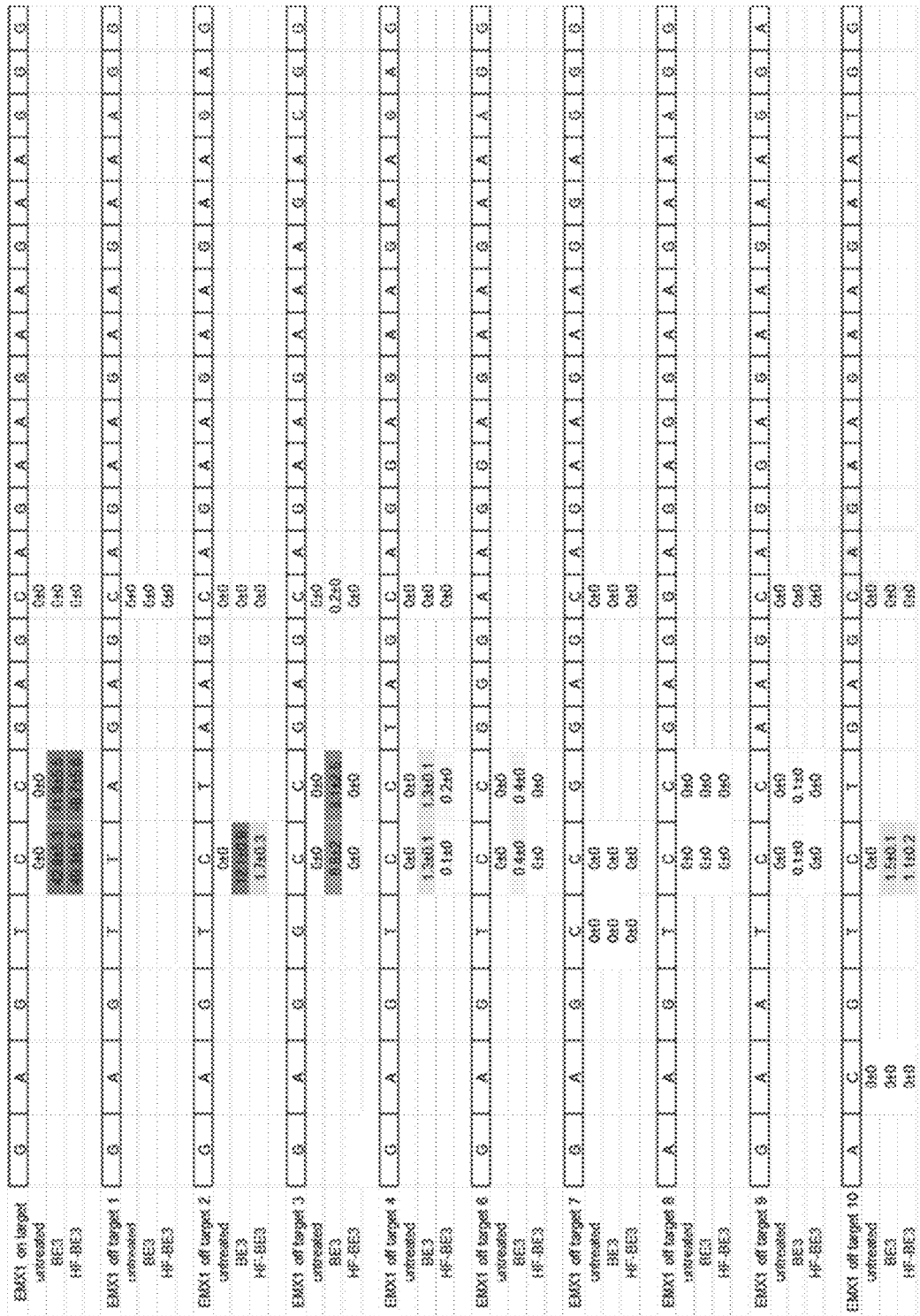

A chloramphenicol reversion assay was designed to test the activity of different cytidine deaminases (e.g., CDA, and APOBEC1). A plasmid harboring a mutant CAT1 gene which confers chloramphenicol resistance to bacteria is constructed with RSF1030 as the replication origin. The mutant CAT1 gene encodings a CAT1 protein that has a H195R (CAC to CGC) mutation, rendering the protein inactive (FIG. 51). Deamination of the C base-paired to the G base in the CGC codon would convert the codon back to a CAC codon, restoring the activity of the protein. As shown in FIG. 52, CDA outperforms rAPOBEC in *E. coli* in restoring the activity of the chloramphenicol resistance gene. The minimum inhibitory concentration (MIC) of chlor in S1030 with the selection plasmid (pNMG_ch_5) was approximately 1 µg/mL. Both rAPOBEC-XTEN-dCas9-UGI and CDA-XTEN-dCas9-UGI induced DNA correction on the selection plasmid (FIG. 53).

Next, the huAPOBEC3G-XTEN-dCas9-UGI protein was tested in the same assay. Interestingly, huAPOBEC3G-XTEN-dCas9-UGI exhibited different sequence specificity than the rAPOBEC1-XTEN-dCas9-UGI fusion protein. Only position 8 was edited with APOBEC3G-XTEN-dCas9-UGI fusion, as compared to the rAPOBEC11-XTEN-dCas9-UGIfusion (in which positions 3, 6, and 8 were edited) (FIG. 54).

Example 8

C to T Base Editors with Less Off Target Editing

Current base editing technologies allow for the sequence-specific conversion of a C:G base pair into a T:A base pair in genomic DNA. This is done via the direct catalytic conversion of cytosine to uracil by a cytidine deaminase enzyme and thus, unlike traditional genome editing technologies, does not introduce double-stranded DNA breaks (DSBs) into the DNA as a first step. See, Komor, A. C., Kim, Y. B., Packer, M. S., Zuris, J. A., and Liu, D. R. (2016), "Programmable editing of a target base in genomic DNA without double-stranded DNA cleavage." Nature 533, 420-424; the entire contents of which are incorporated by reference herein. Instead, catalytically dead SpCas9 (dCas9) or a SpCas9 nickase (dCas9(A840H)) is tethered to a cytidine deaminase enzyme such as rAPOBEC1, pmCDA1, or hAPOBEC3G. The genomic locus of interest is encoded by an sgRNA, and DNA binding and local denaturation is facilitated by the dCas9 portion of the fusion. However, just as wt dCas9 and wt Cas9 exhibit off-target DNA binding and cleavage, current base editors also exhibit C to T editing at Cas9 off-target loci, which limits their therapeutic usefulness.

It has been reported that the introduction of just three to four mutations into SpCas9 that neutralize nonspecific electrostatic interactions between the protein and the sugar-phosphate backbone of its target DNA, increases the DNA binding specificity of SpCas9. See, Kleinstiver, B. P., Patanayak, V., Prew, M. S., Tsai, S. Q., Nguyen, N. T., Zheng, Z., and Joung, J. K. (2016) "High-fidelity CRISPR—Cas9 nucleases with no detectable genome-wide off-target effects." Nature 529, 490-495; and Slaymaker, I. M., Gao, L., Zetsche, B., Scott, D. A., Yan, W. X., and Zhang, F. (2015) "Rationally engineered Cas9 nucleases with improved specificity. Science 351, 84-88; the entire contents of each are hereby incorporated by reference herein. Four reported neutralizing mutations were therefore incorporated into the initially reported base editor BE3 (SEQ ID NO: 285), and found that off-target C to T editing of this enzyme is also drastically reduced (FIG. 55), with no decrease in on-target editing (FIG. 56).

As shown in FIG. 55, HEK293T cells were transfected with plasmids expressing BE3 or HF-BE3 and a sgRNA matching the EMX1 sequence using Lipofectamine 2000. Three days after transfection, genomic DNA was extracted, amplified by PCR, and analyzed by high-throughput DNA sequencing at the on-target locus, plus the top ten known Cas9 off-target loci for the EMX1 sgRNA, as previously determined by Joung and coworkers using the GUIDE-seq method. See Tsai, S. Q., Zheng, Z., Nguyen, N. T., Liebers, M., Topkar, V. V., Thapar, V., Wyvekens, N., Khayter, C., Iafrate, A. J., Le, L. P., et al. (2015) "GUIDE-seq enables genome-wide profiling of off-target cleavage by CRISPR-Cas nucleases." *Nat Biotech* 33, 187-197; the entire contents of which are incorporated by reference herein. EMX1 off-target 5 locus did not amplify and is not shown. Sequences of the on-target and off-target protospacers and protospacer adjacent motifs (PAMs) are displayed (FIG. 55). Cellular C to T conversion percentages, defined as the percentage of total DNA sequencing reads with T at each position of an original C within the protospacer, are shown for BE3 and HF-BE3.

In FIG. 56, HEK293T cells were transfected with plasmids expressing BE3 or HF-BE3 and sgRNAs matching the genomic loci indicated using Lipofectamine 2000. Three days after transfection, genomic DNA was extracted, amplified by PCR, and analyzed by high-throughput DNA sequencing at the on-target loci. The percentage of total DNA sequencing reads with all four bases at the target Cs within each protospacer are shown for treatment with BE3 or HF-BE3 (FIG. 56). Frequencies of indel formation are shown as well.

Primary Protein Sequence of HF-BE3 (SEQ ID NO: 285):

MSSHTGPVAVDPTLRRRIHPHHFHVFFDPRELRKBTCLLYHINWGGRH

SIWRHTSQNTNKHVEVNFIEKFTTERYFCPNTRCSITWFLSWSPCGEC

SRAITEFLSRYPHVTLFIYIARLYHHADPRNRQGLRDLISSGVTIQIM

TEQESGYCWRNFVNYSPSNEAHWPRYPHLWVRLYVLELYCIILGLPPC

LNILRRKQPQLTFFTIALQSCHYQRLPPHILWATGLKSGSETPGTSES

ATPESDKKYSIGLAIGTNSVGWAVITDEYKVPSKKFKVLGNTDRHSIK

KNLIGALLFDSGETAEATRLKRTARRRYTRRKNRICYLQEIFSNEMAK

VDDSFFHRLEESFLVEEDKKHERHPIFGNIVDEVAYHEKYPTIYHLRK

KLVDSTDKADLRLIYLALAHMIKFRGHFLIEGDLNPDNSDVDKLFIQL

VQTYNQLFEENPINASGVDAKAILSARLSKSRRLENLIAQLPGEKKNG

LFGNLIALSLGLTPNFKSNFDLAEDAKLQLSKDTYDDDLDNLLAQIGD

QYADLFLAAKNLSDAILLSDILRVNTEITKAPLSASMIKRYDEHHQDL

TLLKALVRQQLPEKYKEIFFDQSKNGYAGYIDGGASQEEFYKFIKPIL

EKMDGTEELLVKLNREDLLRKQRTFDNGSIPHQIHLGELHAILRRQED

FYPFLKDNREKIEKILTFRIPYYVGPLARGNSRFAWMTRKSEETITPW

NFEEVVDKGASAQSFIERMTAFDKNLPNEKVLPKHSLLYEYFTVYNEL

TKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIV

LTLTLFEDREMIEERLKTYAHLFDDKVMKQLKRRRYTGWGALSRKLIN

GIRDKQSGKTILDFLKSDGFANRNFMALIHDDSLTFKEDIQKAQVSGQ

GDSLHEHIANLAGSPAIKKGILQTVKVVDELVKVMGRHKPENTVIEMA

RENQTTQKGQKNSRERMKRIEEGIKELGSQILKEHPVENTQLQNEKLY

LYYLQNGRDMYVDQELDINRLSDYDVDHIVPQSFLKDDSIDNKVLTRS

DKNRGKSDNVPSEEVVKKMKNYWRQLLNAKLITQRKFDNLTKAERGGL

SELDKAGFIKRQLVETRAITKHVAQILDSRMNTKYDENDKLIREVKVI

TLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITL

ANGEIRKRPLIETNGETGEIVWDKGRDFATVRKVLSMPQVMVKKTEVQ

TGGFSKESILPKRNSDKLIARKKDWDPKKYGGFDSPTVAYSVLVVAKV

EKGKSKKLKSVKELLGITIMERSSFEKNPIDFLEAKGYKEVKKDLIIK

LPKYSLFELENGRKRMLASAGELQKGNELALPSKYVNFLYLASHYEKL

KGSPEDNEQKQLFVEQHKHYLDEIIEQISEFSKRVILADANLDKVLSA

YNKHRDKPIREQAENIIHLFTLTNLGAPAAFNYFDTTIDRKRYTSTKE

VLDATLIHQSITGLYETRIDLSQLGGDSGGSTNLSDIIEKETGKQLVI

QESILMLPEEVEEVIGNKPESDILVHTAYDESTDENVMLLTSDAPEYK

PWALVIQDSNGENKIKMLSGGSPKKKRKV

Example 9

Development of Base Editors that Use Cas9 Variants and Modulation of the Base Editor Processivity to Increase the Target Range and Precision of the Base Editing Technology Unlike traditional genome editing platforms, base editing technology allows precise single nucleotide changes in the DNA without inducing double-stranded breaks(DSBs). See, Komor, A. C. et al. *Nature* 533, 420-424 (2016). The current generation of base editor uses the NGG PAM exclusively. This limits its ability to edit desired bases within the genome, as the base editor needs to be placed at a precise location where the target base is placed within a 4-base region (the 'deamination window'), approximately 15 bases upstream of the PAM . See, Komor, A. C. et al. *Nature* 533, 420-424 (2016). Moreover, due to the high processivity of cytidine deaminase, the base editor may convert all cytidines within its deamination window into thymidines, which could induce amino acid changes other than the one desired by the researcher. See, Komor, A. C. et al. *Nature* 533, 420-424 (2016).

Expanding the Scope of Base Editing Through the Development of Base Editors with Cas9 Variants Cas9 homologs and other RNA-guided DNA binders that have different PAM specificities were incorporated into the base editor architecture. See, Kleinstiver, B. P. et al. *Nature* 523, 481-485 (2015); Kleinstiver, B. P. et al. *Nature Biotechnology* 33, 1293-1298 (2015); and Zetsche, B. et al. *Cell* 163, 759-771 (2015); the entire contents of each are incorporated by reference herein. Furthermore, innovations that have broadened the PAM specificities of various Cas9 proteins were also incorporated to expand the target reach of the base editor even more. See, Kleinstiver, B. P. et al. *Nature* 523, 481-485 (2015); and Kleinstiver, B. P. et al. *Nature Biotechnology* 33, 1293-1298 (2015). The current palette of base editors is summarized in Table 4.

Table 4. New base editors made from Cas9 Variants

| Species | PAM | Base Editor Name | Reference for Cas9 variant |
|---|---|---|---|
| S. pyogenes | . . . NGG | BE3 | Wild-type |
|  | . . . NGA | VQR BE3 or EQR BE3 | Kleinstiver, B. P. et al. |
|  | . . . NGCG | VRER BE3 | Kleinstiver, B. P. et al. |
| S. aureus | . . . NNGRRT | SaBE3 | Wild-type |
|  | . . . NNNRRT | SaKKH BE3 | Kleinstiver, B. P. et al. |
| L. bacterium | TTTN . . . | dCpf1 BE2 | Zetsche, B. et at. |

Modulating Base Editor's Processivity Through Site-directed Mutagenesis of rAPOBEC1

It was reasoned that the processivity of the base editor could be modulated by making point mutations in the deaminase enzyme. The incorporatation of mutations that slightly reduce the catalytic activity of deaminase in which the base editor could still catalyze on average one round of cytidine deamination but was unlikely to access and catalyze another deamination within the relevant timescale were pursued. In effect, the resulting base editor would have a narrower deamination window.

rAPOBEC1 mutations probed in this work are listed in Table 5. Some of the mutations resulted in slight apparent impairment of rAPOBEC1 catalysis, which manifested as preferential editing of one cytidine over another when multiple cytidines are found within the deamination window. Combining some of these mutations had an additive effect, allowing the base editor to discriminate substrate cytidines with higher stringency. Some of the double mutants and the triple mutant allowed selective editing of one cytidine among multiple cytidines that are right next to one another (FIG. 57).

TABLE 5 rAPOBEC1 Point Mutations Investigated

| rAPOBEC1 mutation studied in this work | Corresponding mutation in APOBEC3G | Reference |
|---|---|---|
| H121R/H122R | D315R/D316R | Holden, L. G. et al. |
| R126A | R320A | Chen, K-M. et al. |
| R126E | R320E | Chen, K-M. et al. |
| R118A | R313A | Chen, K-M. et al. |
| W90A | W285A | Chen, K-M. et al. |
| W90Y | W285Y |  |
| R132E | R326E |  |

Base Editor PAM Expansion and Processivity Modulation

The next generation of base editors were designed to expand editable cytidines in the genome by using other RNA-guided DNA binders (FIG. 58). Using a NGG PAM only allows for a single target within the "window" whereas the use of multiple different PAMs allows for Cas9 to be positioned anywhere to effect selective deamination. A variety of new base editors have been created from Cas9 variants (FIG. 59 and Table 4). Different PAM sites (NGA, FIG. 60; NGCG, FIG. 61; NNGRRT, FIG. 62; and NNHRRT, FIG. 63) were explored. Selective deamination was successfully achieved through kinetic modulation of cytidine deaminase point mutagenesis (FIG. 65 and Table 5).

The effect of various mutations on the deamination window was then investigated in cell culture using spacers with multiple cytidines (FIGS. 66 and 67).

Further, the effect of various mutations on different genomic sites with limited numbers of cytidines was examined (FIGS. 68 to 71). It was found that approximately one cytidine will be edited within the deamination windown in the spacer, while the rest of the cytidines will be left intact. Overall, the preference for editing is as follows: $C_6 > C_5 >> C_7 \approx C_4$.

Base Editing Using Cpf1

Cpf1, a Cas9 homolog, can be obtained as AsCpf1, LbCpf1, or from any other species. Schematics of fusion constructs, including BE2 and BE3 equivalents, are shown in FIG. 73. The BE2 equivalent uses catalytically inactive Cpf2 enzyme (dCpf1) instead of Cas9, while the BE3 equivalent includes the Cpf1mutant, which nicks the target strand. The bottom schematic depicts different fusion architectures to combine the two innovations illustrated above it (FIG. 73). The base editing results of HEK293T cell TTTN PAM sites using Cpf1BE2 were examined with different spacers (FIGS. 64A to 64C). In some embodiments, Cpf1may be used in place of a Cas9 domain in any of the base editors provided herein. In some embodiments, the Cpf1is a protein that is at lesst 50%, 55%, 60%, 65%, 70%, 75%, 80%, 85%, 90%, 95%, 98%, 99%, or 99.5% identical to SEQ ID NO 5807.

MSIYQEFVNKYSLSKTLRFELIPQGKTLENIKARGLILDDEKRAKDYK

KAKQIIDKYHQFFIEEILSSVCISEDLLQNYSDVYFKLKKSDDDNLQK

DFKSAKDTIKKQISEYIKDSEKFKNLFNQNLIDAKKGQESDLILWLKQ

SKDNGIELFKANSDITDIDEALEIIKSFKGWITYFKGFHENRKNVYSS

NDIPTSIIYRIVDDNLPKFLENKAKYESLKDKAPEAINYEQIKKDLAE

ELTFDIDYKTSEVNQRVFSLDEVFEIANFNNYLNQSGITKFNTIIGGK

FVNGENTKRKGINEYINLYSQQTNDKTLKKYKMSVLFKQILSDTESKS

FVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDN

PSKKEQELIAKKTEKAKYLSLETIKLALEEFNKHRDIDKQCRFEEILA

NFAAIPMIFDEIAQNKDNLAQISIKYQNQGKKDLLQASAEDDVKAIKD

LLDQTNNLLHKLKIFHISQSEDKANILDKDEHFYLVFEECYFELAMVP

LYNKIRNYITQKPYSDEKFKLNFENSTLANGWDKNKEPDNTAILFIKD

DKYYLGVMNKKNNKIFDDKAIKENKGEGYKKIVYKLLPGANKMLPKVF

FSAKSIKFYNPSEDTLRIRNHSTHTKNGSPQKGYEKFEFNIEDCRKFI

DFYKQSISKHPEWKDFGFRFSDTQRYNSIDEFYREVENQGYKLTFENI

SESYIDSVVNQGKLYLFQIYNKDFSAYSKGRPNLHTLYWKALFDERXL

QDVVYKLNGEAELFYRKQSIPKKITHPAKEAIANKNKDNPKKESVFEY

DLIKDKRITEDKFFFHCPITINFKSSGANKFNDEINLLLKEKANDVHI

LSIDRGERHLAYYTLVDGKGNIIKQDTFNIIGNDRMKTNYHDKLAAIE

KDRDSARKDWKKINNIKEMKEGYLSQVVHEIAKLVIEYNAIVVFEDLN

FGFKRGRFKVEKQVYQKLEKMLIEKLNYLVFKDNEFDKTGGVLRAYQL

TAPFETFKKMGKQTGIIYYVPAGFTSKICPVTGFVNQLYPKYESVSKS

-continued

```
QEFFSKFDKICYNLDKGYFEFSFDYKNFGDKAAKGKWTIASFGSRLIN

FRNSDKNHNWDTREVYPTKELEKLLKDYSIEYGHGECIKAAICGESDK

KFFAKLTSVLNTILQMRNSKTGTELDYLISPVADVNGNFFDSRQAPKN

MPQDADANGAYHIGLKGLMLLGRIKNNQEGKKLNLVIKNEEYFEFVQN

RNN
```

Example 10

Increased Fidelity of Base Editing

Examining the difference between plasmid delivery of BE3 and HF-BE3, it was found that the two edit on-target loci with comparable efficiency (FIGS. 74 and 75). However, HF-BE3 edited off-target loci much less than BE3, meaning that HF-BE3 has a much higher DNA specificity than BE3 (FIG. 76). Deaminase protein lipofection to HEK cells demonstrated that protein delivery of BE3 results in comparable on-target activity, but much better specificity, than plasmid DNA delivery of BE3. Using improved transfection procedures and better plasmids (n=2), the experiment used the following conditions: protein delivery was 125 nM Cas9:sgRNA complex, plasmid delivery was 750 ng BE3/HF-BE3 plasmid+250 ng sgRNA plasmid, and lipofection was with 1.5 µL of Lipofectamine 2000 per well. EMX-1 off target site 2 and FANCF off-target site 1 showed the most off-target editing with BE3, compared to all of the off-targets assayed (FIGS. 77 and 78), while HEK-3 showed no significant editing at off-targets for any of the delivery methods (FIG. 79). HEK-4 shows some C-to-G editing on at the on-target site, while its off-target sites 1, 3, and 4 showed the most off-target editing of all the assayed sites (FIG. 80).

Delivery of BE3 Protein via Micro-injection to Zebrafish

TYR guide RNAs were tested in an in vitro assay for sgRNA activity (FIGS. 81 and 82). The % HTS reads shows how many C residues were converted to T residues during a 2 h incubation with purified BE3 protein and PCR of the resulting product. Experiments used an 80-mer synthetic DNA substate with the target deamination site in 60 bp of its genomic context. This is not the same as % edited DNA strands because only one strand was nicked, so the product is not amplified by PCR. The proportion of HTS reads edited is equal to x/(2−x), where x is the actual proportion of THS reads edited. For 60% editing, the actual proportion of bases edited is 75%. "Off target" is represents BE3 incubated with the same DNA substrate, while bound to an off-target sgRNA. It was found sgRNAs sgRH_13, sgHR_17, and possibly sgHR_16 appeared to be promising targets for in vivo injection experiments.

The delivery of BE3 protein in was tested in vivo in zebrafish. Zebrafish embryos (n=16-24) were injected with either scramled sgRNA, sgHR_13, sgHR_16, or sgHR_17 and purified BE3. Three embryos from each condition were analyzed independently (single embryo) and for each condition, all of the injected embryos were pooled and sequenced as a pool. The results are shown in FIGS. 83 to 85.

Example 11

Uses of Base Editors to Treat Disease

Base editors or complexes provided herein (e.g., BE3) may be used to modify nucleic acids. For example, base editors may be used to change a cytosine to a thymine in a nucleic acid (e.g., DNA). Such changes may be made to, inter alia, alter the amino acid sequence of a protein, to destroy or create a start codon, to create a stop codon, to distupt splicing donors, to disrupt splicing acceptors or edit regulatory sequences. Examples of possible nucleotide changes are shown in FIG. 86.

Base editors or complexes provided herein (e.g., BE3) may be used to edit an isoform of Apolipoprotein E in a subject. For example, an Apolipoprotein E isoform may be edited to yield an isoform associated with a lower risk of developing Alzheimer's disease. Apolipoprotein E has four isoforms that differ at amino acids 112 and 158. APOE4 is the largest and most common genetic risk factor for late-onset Alzheimer's disease. Arginine residue 158 of APOE4, encoded by the nucleic acid sequence CGC, may be changed to a cysteine by using a base editor (e.g., BE3) to change the CGC nucleic acid sequence to TGC, which encodes cysteine at residue 158. This change yields an APOE3r isoform, which is associated with lower Alzheimer's disease risk. See FIG. 87.

It was tested whether base editor BE3 could be used to edit APOE4 to APOE3r in mouse astrocytes (FIG. 88). APOE 4 mouse astrocytes were nucleofected with Cas9+ template or BE3, targeting the nucleic acid encoding Arginine 158 of APOE4. The Cas9+ template yielded only 0.3% editing with 26% indels, while BE3 yielded 75% editing with 5% indels. Two additional base-edited cytosines are silent and do not yield changes to the amino acid sequence (FIG. 88).

Base editors or complexes provided herein may be used to treat prion protein diseases such as Creutzfeldt-Jakob disease and fatal familial insomnia, for example, by introducing mutations into a PRNP gene. Reverting PRNP mutations may not yield therapeutic results, and intels in PRNP may be pathogenic. Accordingly, it was tested whether PRNP could be mutated using base editors (e.g., BE3) to introduce a premature stop codon in the PRNP gene. BE3, associated with its guide RNA,was introduced into HEK cells or glioblastoma cells and was capable of editing the PRNP gene to change the encoded arginine at residue 37 to a stop codon. BE3 yielded 41% editing (FIG. 89).

Additional genes that may be edited include the following: APOE editing of Arg 112 and Arg 158 to treat increased Alzheimer's risk; APP editing of Ala 673 to decrease Alzheimer's risk; PRNP editing of Arg 37 to treat fatal familial insomnia and other prion protein diseases; DMD editing of the exons 23 and 51 splice sites to treat Duchenne muscular dystrophy; FTO editing of intron 1 to treat obesity risk; PDS editing of exon 8 to treat Pendred syndrome (genetic deafness); TMCI editing of exon 8 to treat congenital hearing loss; CYBB editing of various patient-relevant mutations to treat chronic granulomatous disease. Additional diseases that may be treated using the base editors provided herein are shown in Table 6, below.

UGI also plays a key role. Knocking out UDG (which UGI inhibits) was shown to dramatically improve the cleanliness and efficiency of C to T base editing (FIG. 90). Furthermore, base editors with nickase and without UGI were shown to produce a mixture of outcomes, with very high indel rates (FIG. 91).

Example 12

Expanding the Targeting Scope of Base Editing

Base editing is a new approach to genome editing that uses a fusion protein containing a catalytically defective Streptococcus pyogenes Cas9, a cytidine deaminase, and an inhibitor of base excision repair to induce programmable, single-nucleotide C→T (or G→A) changes in DNA without generating double-strand DNA breaks, without requiring a donor DNA template, and without inducing an excess of stochastic insertions and deletions[1]. The development of five new C→T (or G→A) base editors that use natural and engineered Cas9 variants with different protospacer-adjacent motif (PAM) specificities to expand the number of sites that can be targeted by base editing by 2.5-fold are described herein. Additionally, new base editors containing mutated cytidine deaminase domains that narrow the width of the apparent editing window from approximately 5 nucleotides to 1 or 2 nucleotides were engineered, enabling the discrimination of neighboring C nucleotides that would previously be edited with comparable efficiency. Together, these developments substantially increase the targeting scope of base editing.

CRISPR-Cas9 nucleases have been widely used to mediate targeted genome editing[2]. In most genome editing applications, Cas9 forms a complex with a single guide RNA (sgRNA) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR).[3,4] Unfortunately, under most non-perturbative conditions HDR is inefficient, dependent on cell state and cell type, and dominated by a larger frequency of indels.[3,4] As most of the known genetic variations associated with human disease are point mutations, methods[5], that can more efficiently and cleanly make precise point mutations are needed.

Base editing, which enables targeted replacement of a C:G base pair with a T:A base pair in a programmable manner without inducing DSBs[1], has been recently described. Base editing uses a fusion protein between a catalytically inactivated (dCas9) or nickase form of Streptococcus pyogenes Cas9 (SpCas9), a cytidine deaminase such as APOBEC1, and an inhibitor of base excision repair such as uracil glycosylase inhibitor (UGI) to convert cytidines into uridines within a five-nucleotide window specified by the sgRNA.[1] The third-generation base editor, BE3, converts C:G base pairs to T:A base pairs, including disease-relevant point mutations, in a variety of cell lines with higher efficiency and lower indel frequency than what can be achieved using other genome editing methods[1]. Subsequent studies have validated the deaminase-dCas9 fusion approach in a variety of settings[6,7].

Efficient editing by BE3 requires the presence of an NGG PAM that places the target C within a five-nucleotide window near the PAM-distal end of the protospacer (positions 4-8, counting the PAM as positions 21-23)[1]. This PAM requirement substantially limits the number of sites in the human genome that can be efficiently targeted by BE3, as many sites of interest lack an NGG 13- to 17-nucleotides downstream of the target C. Moreover, the high activity and processivity of BE3 results in conversion of all Cs within the editing window to Ts, which can potentially introduce undesired changes to the target locus. Herein, new C:G to T:A base editors that address both of these limitations are described.

It was thought that any Cas9 homolog that binds DNA and forms an "R-loop" complex[8] containing a single-stranded DNA bubble could in principle be converted into a base editor. These new base editors would expand the number of targetable loci by allowing non-NGG PAM sites to be edited. The Cas9 homolog from Staphylococcus aureus (SaCas9) is considerably smaller than SpCas9 (1053 vs. 1368 residues), can mediate efficient genome editing in mammalian cells, and requires an NNGRRT PAM[9]. SpCas9 was replaced with SaCas9 in BE3 to generate SaBE3 and transfected HEK293T cells with plasmids encoding SaBE3 and sgRNAs targeting six human genomic loci (FIGS. 92A and 92B). After 3 d, the genomic loci were subjected to high-throughput DNA sequencing (HTS) to quantify base editing efficiency. SaBE3 enabled C to T base editing of target Cs at a variety of genomic sites in human cells, with very high conversion efficiencies (approximately 50-75% of total DNA sequences converted from C to T, without enrichment for transfected cells) arising from targeting Cs at positions 6-11. The efficiency of SaBE3 on NNGRRT-containing target sites in general exceeded that of BE3 on NGG-containing target sites[1]. Perhaps due to its higher average efficiency, SaBE3 can also result in detectable base editing at target Cs at positions outside of the canonical BE3 activity window (FIG. 92C). In comparison, BE3 showed significantly reduced editing under the same conditions (0-11%), in accordance with the known SpCas9 PAM preference (FIG. 106A)[10]. These data show that SaBE3 can facilitate very efficient base editing at sites not accessible to BE3.

The targeting range of base editors was further expanded by applying recently engineered Cas9 variants that expand or alter PAM specificities. Joung and coworkers recently reported three SpCas9 mutants that accept NGA (VQR-Cas9), NGAG (EQR-Cas9), or NGCG(VRER-Cas9) PAM sequences[11]. In addition, Joung and coworkers engineered a SaCas9 variant containing three mutations (SaKKH-Cas9) that relax its PAM requirement to NNNRRT[12]. The SpCas9 portion of BE3 was replaced with these four Cas9 variants to produce VQR-BE3, EQR-BE3, VRER-BE3, and SaKKH-BE3, which target NNNRRT, NGA, NGAG, and NGCG PAMs respectively. HEK293T cells were transfected with plasmids encoding these constructs and sgRNAs targeting six genomic loci for each new base editor, and measured C to T base conversions using HTS.

SaKKH-BE3 edited sites with NNNRRT PAMs with efficiencies up to 62% of treated, non-enriched cells (FIG. 92D). As expected, SaBE3 was unable to efficiently edit targets containing PAMs that were NNNHRRT (where H=A, C, or T) (FIG. 92D). VQR-BE3, EQR-BE3, and VRER-BE3 exhibited more modest, but still substantial base editing efficiencies of up to 50% of treated, non-enriched cells at genomic loci with the expected PAM requirements with an editing window similar to that of BE3 (FIGS. 92E and 92F). Base editing efficiencies of VQR-BE3, EQR-BE3, and VRER-BE3 in general closely paralleled the reported PAM requirements of the corresponding Cas9 nucleases; for example, EQR-BE3 was unable to efficiently edit targets containing NGAH PAM sequences (FIG. 92F). In contrast, BE3 was unable to edit sites with NGA or NGCG PAMs efficiently (0-3%), likely due to its PAM restrictions (FIG. 106B).

Collectively, the properties of SaBE3, SaKKH-BE3, VQR-BE3, EQR-BE3, and VRER-BE3 establish that base editors exhibit a modularity that facilitates their ability to exploit Cas9 homologs and engineered variants.

Next, base editors with altered activity window widths were developed. All Cs within the activity window of BE3 can be efficiently converted to Ts[1]. The ability to modulate the width of this window would be useful in cases in which it is important to edit only a subset of Cs present in the BE3 activity window.

The length of the linker between APOBEC1 and dCas9 was previously observed to modulate the number of bases that are accessible by APOBEC1 in vitro[1]. In HEK293T cells, however, varying the linker length did not significantly modulate the width of the editing window, suggesting that in the complex cellular milieu, the relative orientation and flexibility of dCas9 and the cytidine deaminase are not strongly determined by linker length (FIG. 96). Next, it was thought that truncating the 5' end of the sgRNA might narrow the base editing window by reducing the length of single-stranded DNA accessible to the deaminase upon formation of the RNA-DNA heteroduplex. HEK293T cells were co-transfected with plasmids encoding BE3 and sgRNAs of different spacer lengths targeting a locus with multiple Cs in the editing window. No consistent changes in the width of base editing when using truncated sgRNAs with 17- to 19-base spacers were observed (FIGS. 95A to 95C). Truncating the sgRNA spacer to fewer than 17 bases resulted in large losses in activity (FIG. 95A).

As an alternative approach, it was thought that mutations to the deaminase domain might narrow the width of the editing window through multiple possible mechanisms. First, some mutations may alter substrate binding, the conformation of bound DNA, or substrate accessibility to the active site in ways that reduce tolerance for non-optimal presentation of a C to the deaminase active site. Second, because the high activity of APOBEC1 likely contributes to the deamination of multiple Cs per DNA binding event,[1,13,14] mutations that reduce the catalytic efficiency of the deaminase domain of a base editor might prevent it from catalyzing successive rounds of deamination before dissociating from the DNA. Once any C:G to T:A editing event has taken place, the sgRNA no longer perfectly matches the target DNA sequence and re-binding of the base editor to the target locus should be less favorable. Both strategies were tested in an effort to discover new base editors that distinguish among multiple cytidines within the original editing window.

Given the absence of an available APOBEC1 structure, several mutations previously reported to modulate the catalytic activity of APOBEC3G, a cytidine deaminase from the same family that shares 42% sequence similarity of its active site-containing domain to that of APOBEC1, were identified[15]. Corresponding APOBEC1 mutations were incorporated into BE3 and evaluated their effect on base editing efficiency and editing window width in HEK293T cells at two C-rich genomic sites containing Cs at positions 3, 4, 5, 6, 8, 9, 10, 12, 13, and 14 (site A); or containing Cs at positions 5, 6, 7, 8, 9, 10, 11, and 13 (site B).

The APOBEC1 mutations R118A and W90A each led to dramatic loss of base editing efficiency (FIG. 97C). R132E led to a general decrease in editing efficiency but did not change the substantially narrow the shape of the editing window (FIG. 97C). In contrast, several mutations that narrowed the width of the editing window while maintaining substantial editing efficiency were found (FIGS. 93A and 97C). The "editing window width" was defined to represent the artificially calculated window width within which editing efficiency exceeds the half-maximal value for that target. The editing window width of BE3 for the two C-rich genomic sites tested was 5.0 (site A) and 6.1 (site B) nucleotides.

R126 in APOBEC1 is predicted to interact with the phosphate backbone of ssDNA[13]. Previous studies have shown that introducing the corresponding mutation into APOBEC3G decreased catalysis by at least 5-fold[14]. Interestingly, when introduced into APOBEC1 in BE3, R126A and R126E increased or maintained activity relative to BE3 at the most strongly edited positions (C5, C6, and C7), while decreasing editing activity at other positions (FIGS. 93A and 97C). Each of these two mutations therefore narrowed the width of the editing window at site A and site B to 4.4 and 3.4 nucleotides (R126A), or to 4.2 and 3.1 nucleotides (R126E), respectively (FIGS. 93A and 97C).

W90 in APOBEC1 (corresponding to W285 in APOBEC3G) is predicted to form a hydrophobic pocket in the APOBEC3G active site and assist in substrate binding[13]. Mutating this residue to Ala abrogated APOBEC3G's catalytic activity[3]. In BE3, W90A almost completely abrogated base editing efficiency (FIG. 97C). In contrast, it was found that W90Y only modestly decreased base editing activity while narrowing the editing window width at site A and site B to 3.8 and 4.9 nucleotides, respectively (FIG. 93A). These results demonstrate that mutations to the cytidine deaminase domain can narrow the activity window width of the corresponding base editors.

W90Y, R126E, and R132E, the three mutations that narrowed the editing window without drastically reducing base editing activity, were combined into doubly and triply mutated base editors. The double mutant W90Y+R126E resulted in a base editor (YE1-BE3) with BE3-like maximal editing efficiencies, but substantially narrowed editing window width (width at site A and site B=2.9 and 3.0 nucleotides, respectively (FIG. 93A). The W90Y+R132E base editor (YE2-BE3) exhibited modestly lower editing efficiencies (averaging 1.4-fold lower maximal editing yields across the five sites tested compared with BE3), and also substantially narrowed editing window width (width at site A and site B=2.7 and 2.8 nucleotides, respectively) (FIG. 97C). The R126E+R132E double mutant (EE-BE3) showed similar maximal editing efficiencies and editing window width as YE2-BE3 (FIG. 97C). The triple mutant W90Y+R126E+R132E (YEE-BE3) exhibited 2.0-fold lower average maximal editing yields but very little editing beyond the C6 position and an editing window width of 2.1 and 1.4 nucleotides for site A and site B, respectively (FIG. 97C). These data taken together indicate that mutations in the cytidine deaminase domain can strongly affect editing window widths, in some cases with minimal or only modest effects on editing efficiency.

The base editing outcomes of BE3, YE1-BE3, YE2-BE3, EE-BE3, and YEE-BE3 were further compared in HEK293T cells targeting four well-studied human genomic sites that contain multiple Cs within the BE3 activity window[1]. These target loci contained target Cs at positions 4 and 5 (HEK site 3), positions 4 and 6 (HEK site 2), positions 5 and 6 (EMX1), or positions 6, 7, 8, and 11 (FANCF). BE3 exhibited little (<1.2-fold) preference for editing any Cs within the position 4-8 activity window. In contrast, YE1-BE3, exhibited a 1.3-fold preference for editing C5 over C4 (HEK site 3), 2.6-fold preference for C6 over C4 (HEK site 2), 2.0-fold preference for C5 over C6 (EMX1), and 1.5-fold preference for C6 over C7 (FANCF) (FIG. 93B). YE2-BE3 and EE-BE3 exhibited somewhat greater positional specificity (narrower activity window) than YE1-BE3, averaging 2.4-fold preference for editing C5 over C4 (HEK site 3), 9.5-fold preference for C6 over C4 (HEK site 2), 2.9-fold preference for C5 over C6 (EMX1), and 2.6-fold preference for C7 over C6 (FANCF) (FIG. 93B). YEE-BE3 showed the greatest positional selectivity, with a 2.9-fold preference for editing C5 over C4 (HEK site 3), 29.7-fold preference for C6 over C4 (HEK site 2), 7.9-fold preference for C5 over C6 (EMX1), and 7.9-fold preference for C7 over C6 (FANCF) (FIG. 93B). The findings establish that mutant base editors can discriminate between adjacent Cs, even when both nucleotides are within the BE3 editing window.

The product distributions of these four mutants and BE3 were further analyzed by HTS to evaluate their apparent processivity. BE3 generated predominantly T4-T5 (HEK site 3), T4-T6 (HEK site 2), and T5-T6 (EMX1) products in treated HEK293T cells, resulting in, on average, 7.4-fold more products containing two Ts, than products containing a single T. In contrast, YE1-BE3, YE2-BE3, EE-BE3, and YEE-BE3 showed substantially higher preferences for singly edited C4-T5, C4-T6, and T5-C6 products (FIG. 93C). YE1-BE3 yielded products with an average single-T to double-T product ratio of 1.4. YE2-BE3 and EE-BE3 yielded products with an average single-T to double-T product ratio of 4.3 and 5.1, respectively (FIG. 93C). Consistent with the above results, the YEE-BE3 triple mutant favored single-T products by an average of 14.3-fold across the three genomic loci. (FIG. 93C). For the target site in which only one C is within the target window (HEK site 4, at position C5), all four mutants exhibited comparable editing efficiencies as BE3 (FIG. 98). These findings indicate that these BE3 mutants have decreased apparent processivity and can favor the conversion of only a single C at target sites containing multiple Cs within the BE3 editing window. These data also suggest a positional preference of C5>C6>C7≈C4 for these mutant base editors, although this preference could differ depending on the target sequence.

The window-modulating mutations in APOBEC1 were applied to VQR-BE3, allowing selective base editing of substrates at sites targeted by NGA PAM (FIG. 107A). However, when these mutations were applied to SaKKH-BE3, a linear decrease in base editing efficiency was observed without the improvement in substrate selectivity, suggesting a different kinetic equilibrium and substrate accessibility of this base editor than those of BE3 and its variants (FIG. 107B).

The five base editors with altered PAM specificities described in this study together increase the number of disease-associated mutations in the ClinVar database that can in principle be corrected by base editing by 2.5-fold (FIGS. 94A and 94B). Similarly, the development of base editors with narrowed editing windows approximately doubles the fraction of ClinVar entries with a properly positioned NGG PAM that can be corrected by base editing without comparable modification of a non-target C (from 31% for BE3 to 59% for YEE-BE3) (FIGS. 94A and 94B).

In summary, the targeting scope of base editing was substantially expanded by developing base editors that use Cas9 variants with different PAM specificities, and by developing a collection of deaminase mutants with varying editing window widths. In theory, base editing should be possible using other programmable DNA-binding proteins (such as Cpf1[16]) that create a bubble of single-stranded DNA that can serve as a substrate for a single-strand-specific nucleotide deaminase enzyme.

Materials and Methods

Cloning. PCR was performed using Q5 Hot Start High-Fidelity DNA Polymerase (New England Biolabs). Plasmids for BE and sgRNA were constructed using USER cloning (New England Biolabs), obtained from previously reported plasmids[1]. DNA vector amplification was carried out using NEB 10beta competent cells (New England Biolabs).

Cell culture. HEK293T (ATCC CRL-3216) were cultured in Dulbecco's Modified Eagle's Medium plus GlutaMax (ThermoFisher) supplemented with 10% (v/v) fetal bovine serum (FBS), at 37° C. with 5% $CO_2$. Immortalized rat astrocytes containing the ApoE4 isoform of the APOE gene (Taconic Biosciences) were maintained in Dulbecco's Modified Eagle's Medium plus GlutaMax (ThermoFisher Scientific) supplemented with 10% (v/v) fetal bovine serum (FBS) and 200 µg/mL Geneticin (ThermoFisher Scientific).

Transfections. HEK293T cells were seeded on 48-well collagen-coated BioCoat plates (Corning) and transfected at approximately 85% confluency. 750 ng of BE and 250 ng of sgRNA expression plasmids were transfected using 1.5 µl of Lipofectamine 2000 (ThermoFisher Scientific) per well according to the manufacturer's protocol.

High-throughput DNA sequencing of genomic DNA samples. Transfected cells were harvested after 3 d and the genomic DNA was isolated using the Agencourt DNAdvance Genomic DNA Isolation Kit (Beckman Coulter) according to the manufacturer's instructions. Genomic regions of interest were amplified by PCR with flanking HTS primer pairs listed in the Supplementary Sequences. PCR amplification was carried out with Phusion hot-start II DNA polymerase (ThermoFisher) according to the manufacturer's instructions. PCR products were purified using RapidTips (Diffinity Genomics). Secondary PCR was performed to attach sequencing adaptors. The products were gel-purified and quantified using the KAPA Library Quantification Kit-Illumina (KAPA Biosystems). Samples were sequenced on an Illumina MiSeq as previously described[1].

Data analysis. Nucleotide frequencies were assessed using a previously described MATLAB script[1]. Briefly, the reads were aligned to the reference sequence via the Smith-Waterman algorithm. Base calls with Q-scores below 30 were replaced with a placeholder nucleotide (N). This quality threshold results in nucleotide frequencies with an expected theoretical error rate of 1 in 1000.

Analyses of base editing processivity were performed using a custom python script. This program trims sequencing reads to the 20 nucleotide protospacer sequence as determined by a perfect match for the 7 nucleotide sequences that should flank the target site. These targets were then consolidated and sorted by abundance to assess the frequency of base editing products.

Bioinformatic analysis of the ClinVar database of human disease-associated mutations was performed in a manner similar to that previously described but with small adjustments[1]. These adjustments enable the identification of targets with PAMs of customizable length and sequence. In addition, this improved script includes a priority ranking of target C positions (C5>C6>C7>C8≈C4), thus enabling the identification of target sites in which the on-target C is either the only cytosine within the window or is placed at a position with higher predicted editing efficiency than any off-target C within the editing window.

References for Example 12

1 Komor, A. C. et al. Programmable editing of a target base in genomic DNA without double-stranded DNA cleavage. *Nature* 533, 420-424 (2016).
2 Sander, J. D. & Joung, J. K. CRISPR-Cas systems for editing, regulating and targeting genomes. *Nature biotechnology* 32, 347-355 (2014).
3 Cong, L. et al. Multiplex genome engineering using CRISPR/Cas systems. *Science* 339, 819-823 (2013).

4 Ran, F. A. et al. Genome engineering using the CRISPR-Cas9 system. *Nat. Protocols* 8, 2281-2308 (2013).
5 Landrum, M. J. et al. ClinVar: public archive of interpretations of clinically relevant variants. *Nucleic Acids Res.* 44, D862-D868 (2015).
6 Nishida, K. et al. Targeted nucleotide editing using hybrid prokaryotic and vertebrate adaptive immune systems. *Science* 353, aaf8729-1-8 (2016).
7 Ma, Y. et al. Targeted AID-mediated mutagenesis (TAM) enables efficient genomic diversification in mammalian cells. *Nat. Methods* doi:10.1038/nmeth.4027 (2016).
8 Jiang, F. et al. Structures of a CRISPR-Cas9 R-loop complex primed for DNA cleavage. *Science* 351, 867-71 (2016).
9 Ran, F. A. et al. In vivo genome editing using Staphylococcus aureus Cas9. *Nature* 520, 186-191 (2015).
10 Zhang, Y. et al. Comparison of non-canonical PAMs for CRISPR/Cas9-mediated DNA cleavage in human cells. *Sci. Rep.* 4, (2014).
11 Kleinstiver, B. P. et. al. Engineered CRISPR-Cas9 nucleases with altered PAM specificities. *Nature* 523, 481-485 (2015).
12 Kleinstiver, B. P. et. al. Broadening the targeting range of *Staphylococcus aureus* CRISPR-Cas9 by modifying PAM recognition. *Nat. Biotechnol.* 33, 1293-1298 (2015).
13 Holden, L. G. et al. Crystal structure of the anti-viral APOBEC3G catalytic domain and functional implications. *Nature* 452, 121-124 (2008).
14 Chen, K.-M. et al. Structure of the DNA deaminase domain of the HIV-1 restriction factor APOBEC3G. *Nature* 452, 116-119 (2008).
15 Harris, R. S., Petersen-Mahrt, S. K. & Neuberger, M. S. RNA Editing Enzyme APOBEC1 and Some of Its Homologs Can Act as DNA Mutators. *Molecular Cell* 10, 1247-1253 (2002).
16 Zetsche, B. et al. Cpf1 Is a Single RNA-Guided Endonuclease of a Class 2 CRISPR-Cas System. *Cell* 163, 759-771 (2015).

Example 13

Using improved transfection procedures and better plasmids, biological replicates (n=3) were used to install the four HF mutations into the Cas9 portion of BE3. The muations do not significantly effect on-targeting editing with plasmid delivery (FIG. 99). At the tested concentration, BE3 protein delivery works; however, the on-target editing is lower than for plasmid delivery (FIG. 100). Protein delivery of BE3 with the HF mutations installed reduces on-targeting ediing efficiency but still yields some edited cells (FIG. 101).

Both lipofection and installing HF mutations were shown to decrease off-target deamination events. For the four sites shown in FIG. 102, the off-target sitest (OT) with the highest GUIDE-Seq reads and deamination events were assayed (Komor et al., *Nature*, 2016). The specificity ratio was calculated by dividing the off-target editing by the on-target editing at the closest corresponding C. In cases where off-target editing was not detectable, the ratio was set to 100. Thus, a higher specificity ratio indicates a more specific construct. BE3 plasmid delivery showed much higher off-target/on-target editing than protein delivery of BE3, plasmid delivery of HF-BE3, or protein delivery of HF-BE3 (FIGS. 102 and 105).

Purified proteins HF-BE3 and BE3 were analyzed in vitro for their capabilities to convert C to T residues at different positions in the spacer with the most permissive motif. Both BE3 and HF-BE3 proteins were found to have the same "window" for base editing (FIGS. 103 and 104).

A list of the disease targets is given in Table 9. The base to be edited in Table 9 is indicated in bold and underlined.

TABLE 9

Base Editor Disease Targets

| GENE | DISEASE | SPACER | SEQ ID NO: | PAM | EDITOR | DEFECT | CELL |
|---|---|---|---|---|---|---|---|
| RB1 | RETINO-BLASTOMA | AATCTAGTAAA TAAATTGATGT | 4120 | AAA AGT | SAKKH-BE3 | SPLICING IMPAIRMENT | J82 |
| PTEN | CANCER | GACCAACGGCT AAGTGAAGA | 4121 | TGA | VQR-BE3 | W111R | MC116 |
| PIK3CA | CANCER | TCCTTTCTTCA CGGTTGCCT | 4122 | ACT GGT | SAKKH-BE3 | K111R | CRL-5853 |
| PIK3CA | CANCER | CTCCTGCTCAG TGATTTCAG | 4123 | AGA | VQR-BE3 | Q546R | CRL-2505 |
| TP53 | CANCER | TGTCACACATG TAGTTGTAG | 4124 | TGG | YEE-BE3 | N239D | SNU475 |
| HRAS | CANCER | CCTCCCGGCCG GCGGTATCC | 4125 | AGO | YEE-BE3 | Q61R | MC/CAR |

TABLE 6

Exemplary diseases that may be treated using base editors. The protospacer and PAM sequences are shown in the sgRNA (PAM) column. The PAM sequence is shown in parentheses and with the base to be edited indicated by underlining. The sgRNA (PAM) sequences, from top to bottom, correspond to SEQ ID NOs: 4126-4138.

| Disease target | gene symbol | Base changed | sgRNA (PAM) | Base editor |
|---|---|---|---|---|
| Prion disease | PRNP | R37* | GGCAGCCGATACCCGGGCA(GGG)<br>GGGCAGCCGATACCCGGGGC(AGG) | BE3 |
| Pendred syndrome | Slc26a4 | c.919-2A > G | TTATTGTCCGAAATAAAAGA(AGA)<br>ATTGTCCGAAATAAAAGAAG(AGG)<br>TTGTCCGAAATAAAAGAAGA(GGA)<br>GTCCGAAATAAAAGAAGAGGAAAA(AAT)<br>GTCCGAAATAAAAGAAGAGGAAAAA(ATT) | BE3<br>(VQR<br>SaCas9) |
| Congenital deafness | Tmc1 | c.545A > G | CAGGAAGCACGAGGCCACTG(AGG)<br>AACAGGAAGCACGAGGCCAC(TGA)<br>AGGAAGCACGAGGCCACTGA(GGA) | BE3<br>YE-BE3<br>YEE-BE3 |
| Acquired deafness | SNHL | S33F | TTGGATTCTGGAATCCATTC(TGG) | BE3 |
| Alzheimer's Disease | APP | A673T | TCTGCATCCATCTTCACTTC(AGA) | BE3 VQR |
| Niemann-Pick Disease Type C | NPC1 | I1061T | CTTACAGCCAGTAATGTCAC(CGA) | BE3 VQR |

Additional exemplary genes in the human genome that may be targeted by the base editors or complexes of this disclosure are provided herein in Tables 7 and 8. Table 7 includes gene mutations that may be correcteded by changing a cytosine (C) to a thymine (T), for example, using a BE3 nucleobase editor. Table 8 includes gene mutations that may be corrected by changing a guanine (G) to an adenine (A), for example, using a BE3 nucleobase editor.

TABLE 7

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000138.4(FBN1): c.3220T > C (p.Cys1074Arg) | 137854465 | FBN1 | [ ] | [ ] | [ ] |
| NM_001927.3(DES): c.1154T > C (p.Leu385Pro) | 57955682 | DES | [ ] | [ ] | ['Myofibrillar myopathy 1', 'not provided'] |
| NM_025152.2(NUBPL): c.815-27T > C | 118161496 | NUBPL | [ ] | ['TGGTTCYAATGG ATGTCTGCTGG', 'GGTTCYAATGGA TGTCTGCTGGG'] | ['Mitochondrial complex I deficiency', 'not provided'] |
| NM_003000.2(SDHB): c.574T > C (p.Cys192Arg) | 786202732 | SDHB | [ ] | [ ] | ['Hereditary cancer-predisposing syndrome'] |
| NM_004586.2(RPS6KA3): c.803T > C (p.Phe268Ser) | 122454131 | RPS6KA3 | [ ] | [ ] | ['Coffin-Lowry syndrome'] |
| NM_005609.2(PYGM): c.425_528del | 764313717 | PYGM | [ ] | ['TGGCTGYCAGG GACCCAGCAAGG', 'CTGYCAGGGACC CAGCAAGGAGG'] | [ ] |
| NM_000124.3(ERCC6): c.2830-2A > G | 373227647 | ERCC6 | [ ] | [ ] | ['Cockayne syndrome, type B'] |
| NM_000059.3(BRCA2): c.316 + 2T > C | 81002805 | BRCA2 | ['CTTAG GYAAG TAATG CAATA TGG'] | ['CTTAGGYAAGTA ATGCAATATGG'] | ['Familial cancer of breast', 'Breast-ovarian cancer, familial 2', 'Hereditary cancer-predisposing syndrome'] |
| NM_003242.5(TGFBR2): c.923T > C (p.Leu308Pro) | 28934568 | TGFBR2 | [ ] | ['AGTTCCYGACGG CTGAGGAGCGG'] | ['Loeys-Dietz syndrome 2'] |
| NM_000410.3(HFE): c.314T > C (p.Ile105Thr) | 28934596 | HFE | [ ] | [ ] | ['Hemochromatosis type 1'] |
| NM_000308.2(CTSA): | 28934603 | CTSA | [ ] | [ ] | ['Combined |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.247T > C (p.Trp83Arg) | | | | | deficiency of sialidase AND beta galactosidase'] |
| NM_033290.3(MID1): c.1877T > C (p.Leu626Pro) | 28934611 | MID1 | [ ] | [ ] | ['Opitz-Frias syndrome'] |
| NM_000329.2(RPE65): c.1102T > C (p.Tyr368His) | 62653011 | RPE65 | [ ] | [ ] | ['Leber congenital amaurosis 2', 'Retinitis pigmentosa 20', 'not provided'] |
| NM_007313.2(ABL1): c.814T > C (p.Tyr272His) | 121913461 | ABL1 | [ ] | ['CCAGYACGGGG AGGTGTACGAGG', 'CAGYACGGGGAG GTGTACGAGGG'] | [ ] |
| NM_000546.5(TP53): c.398T > C (p.Met133Thr) | 28934873 | TP53 | [ ] | [ ] | ['Li-Fraumeni syndrome 1'] |
| NM_000490.4(AVP): c.200T > C (p.Val67Ala) | 28934878 | AVP | [ ] | [ ] | ['Neurohypophyseal diabetes insipidus'] |
| NM_021961.5(TEAD1): c.1261T > C (p.Tyr?His) | 11567847 | TEAD1 | ['TCATA TTYAC AGGCT TGTAA AGG'] | ['TCATATTYACAG GCTTGTAAAGG'] | [ ] |
| NM_002609.3(PDGFRB): c.1973T > C (p.Leu658Pro) | 397509381 | PDGFRB | [ ] | [ ] | ['Basal ganglia calcification, idiopathic, 4'] |
| NM_005236.2(ERCC4): c.689T > C (p.Leu230Pro) | 397509402 | ERCC4 | [ ] | [ ] | ['Fanconi anemia, complementation group Q'] |
| NM_005236.2(ERCC4): c.706T > C (p.Cys236Arg) | 397509403 | ERCC4 | [ ] | [ ] | ['XERODERMA PIGMENTOSUM, TYPE F/COCKAYNE SYNDROME'] |
| NM_173551.4(ANKS6): c.1322A > G (p.Gln441Arg) | 377750405 | ANKS6 | [ ] | ['AGGGCYGTCGG ACCTTCGAGTGG', 'GGGCYGTCGGAC CTTCGAGTGGG', 'GGCYGTCGGACC TTCGAGTGGGG1 | ['Nephronophthisis 16'] |
| NM_000142.4(FGFR3): c.1612A > G (p.Ile538Val) | 80053154 | FGFR3 | [ ] | [ ] | ['Hypochondroplasia'] |
| NM_000441.1(SLC26A4): c.707T > C (p.Leu236Pro) | 80338848 | SLC26A4 | [ ] | [ ] | ['Pendred syndrome', 'Enlarged vestibular aqueduct syndrome'] |
| NM_000518.4(HBB): c.337T > C (p.Cys113Arg) | 35849199 | HBB | [ ] | [ ] | [ ] |
| NM_000104.3(CYP1B1): c.2T > C (p.Met1Thr) | 72549389 | CYP1B1 | [ ] | [ ] | ['Irido-corneo-trabecular dysgenesis'] |
| NM_000169.2(GLA): c.484T > C (p.Trp162Arg) | 28935196 | — | [ ] | [ ] | ['Fabry disease'] |
| NM_001927.3(DES): c.1034T > C (p.Leu345Pro) | 57639980 | DES | [ ] | ['ATTCCCYGATGA GGCAGATGCGG', 'TTCCCYGATGAG GCAGATGCGGG] | ['Myofibrillar myopathy 1', 'not provided'] |
| NM_006517.4(SLC16A2): c.1190T > C (p.Leu397Pro) | 122455132 | SLC16A2 | [ ] | [ ] | ['Allan-Herndon-Dudley syndrome'] |
| NM_020320.3(RARS2): c.35A > G (p.Gln12Arg) | 147391618 | RARS2 | [ ] | ['ATACCYGGCAA GCAATAGCGCGG'] | ['Pontocerebellar hypoplasia type 6'] |
| NM_000239.2(LYZ): c.221T > C (p.Ile74Thr) | 121913547 | LYZ | [ ] | [ ] | ['Familial visceral amyloidosis, Ostertag type'] |
| NM_002977.3(SCN9A): c.2215A > G (p.Ile739Val) | 182650126 | — | [ ] | ['GTAAYTGCAAG ATCTACAAAAGG'] | ['Small fiber neuropathy', 'not provided'] |
| NM_004700.3(KCNQ4): | 80358278 | KCNQ4 | [ ] | ['ACATYGACAAC | ['DFNA 2 |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.842T > C (p.Leu281Ser) | | | | CATCGGCTATGG'] | Nonsyndromic Hearing Loss'] |
| NM_000169.2(GLA):c.806T > C (p.Val269Ala) | 28935488 | — | ['CAGTTAGYGATTGGCAACTTTGG'] | ['CAGTTAGYGATTGGCAACTTTGG'] | ['Fabry disease'] |
| NM_000228.2(LAMB3): c.565-2A > G | 370148688 | LAMB3 | [ ] | [ ] | ['Junctional epidermolysis bullosa gravis of Herlitz'] |
| NM_052867.2(NALCN): c.1526T > C (p.Leu509Ser) | 786203987 | NALCN | [ ] | [ ] | ['CONGENITAL CONTRACTURES OF THE LIMBS AND FACE, HYPOTONIA, AND DEVELOPMENTAL DELAY'] |
| NM_001031.4(RP528): c.1A > G (p.Met1Val) | 786203997 | RP528 | ['CCAYGATGGCGGCGCGGCGGCGG'] | ['TGTCCAYGATGGCGGCGCGGCGG', 'CCAYGATGGCGGCGCGGCGGCGG'] | ['Diamond-Blackfan anemia with microtia and cleft palate'] |
| NM_005957.4(MTHFR): c.388T > C (p.Cys130Arg) | 786204012 | MTHFR | [ ] | ['GACCYGCTGCCGTCAGCGCCTGG'] | ['Homocysteinemia due to MTHFR deficiency'] |
| NM_005957.4(MTHFR): c.1530 + 2T > C | 786204027 | MTHFR | ['GAAGGYGTGGTAGGGAGGCACGG', 'AAGGYGTGGTAGGGAGGCACGGG', 'AGGYGTGGTAGGGAGGCACGGG'] | ['GAAGGYGTGGTAGGGAGGCACGG', 'AAGGYGTGGTAGGGAGGCACGGG', 'AGGYGTGGTAGGGAGGCACGGG'] | ['Homocysteinemia due to MTHFR deficiency'] |
| NM_005957.4(MTHFR): c.1793T > C (p.Leu598Pro) | 786204034 | MTHFR | [ ] | [ ] | ['Homocysteinemia due to MTHFR deficiency'] |
| NM_005957.4(MTHFR): c.1883T > C (p.Leu628Pro) | 786204037 | MTHFR | [ ] | ['TCCCACYGGACAACTGCCTCTGG'] | ['Homocysteinemia due to MTHFR deficiency'] |
| NM_000264.3(PTCH1): c.3168 + 2T > C | 786204056 | PTCH1 | ['ATCATTGYGAGTGTATTATAAGG', 'TCATTGYGAGTGTATTATAAGGG', 'CATTGYGAGTGTATTATAAGGGG'] | ['ATCATTGYGAGTGTATTATAAGG', 'TCATTGYGAGTGTATTATAAGGG', 'CATTGYGAGTGTATTATAAGGGG'] | ['Gorlin syndrome'] |
| NM_000182.4(HADHA): c.919-2A > G | 200017313 | HADHA | [ ] | [ ] | ['Mitochondrial trifunctional protein deficiency', 'Long-chain 3-hydroxyacyl-CoA dehydrogenase deficiency', 'not provided'] |
| NM_000030.2(AGXT): c.806T > C | 180177271 | AGXT | [ ] | [ ] | ['Primary hyperoxaluria, type |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Leu269Pro) | | | | | 1'] |
| NM_006121.3(KRT1): c.1436T > C (p.Ile479Thr) | 57837128 | KRT1 | [ ] | [ ] | ['Ichthyosis, cyclic, with epidermolytic hyperkeratosis', 'not provided'] |
| NM_000521.3(HEXB): c.185C > T (p.Ser62Leu) | 820878 | HEXB | [ ] | [ ] | ['Sandhoff disease, infantile type'] |
| NM_000140.3(FECH): c.1137 + 3A > G | 202147607 | FECH | [ ] | ['GTAGAYACCTTA GAGAACAATGG'] | ['Erythropoietic protoporphyria'] |
| NM_015046.5(SETX): c.1166T > C (p.Leu389Ser) | 29001584 | SETX | [ ] | [ ] | ['Amyotrophic lateral sclerosis type 4'] |
| NM_020365.4(EIF2B3): c.1037T > C (p.Ile346Thr) | 119474039 | EIF2B3 | ['CCAG AYTGT CAGCA AACAC CTGG'] | ['CCAGAYTGTCAG CAAACACCTGG'] | ['Leukoencephalopat hy with vanishing white matter'] |
| NM_139058.2(ARX): c.98T > C (p.Leu33Pro) | 28936077 | ARX | [ ] | [ ] | ['Mental retardation, with or without seizures, ARX-related, X-linked'] |
| NM_005183.3(CACNA1F): c.2267T > C (p.Ile756Thr) | 122456136 | CACNA1F | [ ] | ['TGCCAYTGCTGT GGACAACCTGG'] | [ ] |
| NM_007374.2(SIX6): c.110T > C (p.Leu37Pro) | 786204851 | SIX6 | [ ] | [GTCGCYGCCCGT GGCCCCTGCGG'] | ['Cataract, microphthalmia and nystagmus'] |
| NM_000339.2(SLC12A3): c.1261T > C (p.Cys421Arg) | 28936387 | SLC12A3 | [ ] | [ ] | ['Familial hypokalemia-hypomagnesemia'] |
| NM_003865.2(HESX1): c.77T > C (p.Ile26Thr) | 28936416 | HESX1 | [ ] | [ ] | ['Pituitary hormone deficiency, combined 5'] |
| NM_022114.3(PRDM16): c.2660T > C (p.Leu887Pro) | 202115331 | PRDM16 | [ ] | [ ] | ['Dilated cardiomyopathy 1LL'] |
| NM_001159287.1(TPI1): c.832T > C (p.Phe278Leu) | 121964847 | TPI1 | [ ] | [ ] | ['Triosephosphate isomerase deficiency'] |
| NM_001692.3(ATP6V1B1): c.242T > C (p.Leu81Pro) | 121964880 | ATP6V1B1 | [ ] | [ ] | [ ] |
| NM_000490.4(AVP): c.61T > C (p.Tyr21His) | 121964893 | AVP | [ ] | [ ] | ['Neurohypophyseal diabetes insipidus'] |
| NM_000027.3(AGA): c.916T > C (p.Cys306Arg) | 121964906 | AGA | ['GTTAT AYGTG CCAAT GTGAC TGG'] | ['GTTATAYGTGCC AATGTGACTGG'] | ['Aspartylglycosaminuria'] |
| NM_000138.4(FBN1): c.1468 + 2T > C | 794728167 | FBN1 | [ ] | ['ATTGGYACGTGA TCCATCCTAGG'] | ['Thoracic aortic aneurysms and aortic dissections'] |
| NM_000027.3(AGA): c.214T > C (p.Ser72Pro) | 121964909 | AGA | [ ] | ['GACGGCYCTGTA GGCTTTGGAGG'] | ['Aspartylglycosaminuria'] |
| NM_004453.3(ETFDH): c.1001T > C (p.Leu334Pro) | 377686388 | ETFDH | [ ] | [ ] | ['Glutaric aciduria, type 2'] |
| NM_001385.2(DPYS): c.1078T > C (p.Trp360Arg) | 121964924 | DPYS | ['CGTA ATAYG GGAAA AAGGC GTGG', 'AATAY GGGAA AAAGG CGTGG TGG', 'ATAYG GGAAA AAGGC GTGGT GGG'] | ['CGTAATAYGGG AAAAAGGCGTGG', 'AATAYGGGAAAA AGGCGTGGTGG', 'ATAYGGGAAAAA GGCGTGGTGGG'] | ['Dihydropyrimidinase deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_004453.3(ETFDH): c.2T > C (p.Met1Thr) | 121964953 | ETFDH | [ ] | [ ] | ['Glutaric acidemia IIC'] |
| NM_000071.2(CBS): c.1616T > C (p.Leu539Ser) | 121964968 | CBS | [ ] | [ ] | ['Homocystinuria, pyridoxine-responsive'] |
| NM_000170.2(GLDC): c.2T > C (p.Met1Thr) | 121964978 | GLDC | [ ] | ['CGGCCAYGCAG TCCTGTGCCAGG', 'GGCCAYGCAGTC CTGTGCCAGGG'] | ['Non-ketotic hyperglycinemia'] |
| NM_000108.4(DLD): c.1178T > C (p.Ile393Thr) | 121964991 | DLD | [ ] | [ ] | ['Maple syrup urine disease, type 3'] |
| NM_014425.3(INVS): c.1478T > C (p.Leu493Ser) | 121964995 | INVS | [ ] | [ ] | ['Infantile nephronophthisis'] |
| NM_000398.6(CYB5R3): c.382T > C (p.Ser128Pro) | 121965006 | CYB5R3 | [ ] | [ ] | ['Methemoglobinemia type 2'] |
| NM_000398.6(CYB5R3): c.446T > C (p.Leu149Pro) | 121965008 | CYB5R3 | [ ] | ['CTGCYGGTCTAC CAGGGCAAAGG'] | ['METHEMOGLOBINEMIA, TYPE I'] |
| NM_000398.6(CYB5R3): c.610T > C (p.Cys204Arg) | 121965011 | CYB5R3 | [ ] | [ ] | ['Methemoglobinemia type 2'] |
| NM_000398.6(CYB5R3): c.218T > C (p.Leu73Pro) | 121965013 | CYB5R3 | [ ] | [ ] | ['METHEMOGLOBINEMIA, TYPE I'] |
| NM_001103.3(ACTN2): c.683T > C (p.Met228Thr) | 786205144 | ACTN2 | ['CCTA AAAYG TTGGA TGCTG AAGG'] | ['CCTAAAAYGTTG GATGCTGAAGG'] | ['Dilated cardiomyopathy 1AA'] |
| NM_000548.3(TSC2): c.3106T > C (p.Ser1036Pro) | 45517281 | TSC2 | [ ] | [ ] | ['Tuberous sclerosis syndrome', 'Tuberous sclerosis 2'] |
| NM_000203.4(IDUA): c.1469T > C (p.Leu490Pro) | 121965027 | IDUA | [ ] | [ ] | ['Mucopolysaccharidosis, MPS-I-H/S', 'Hurler syndrome', 'not provided'] |
| NM_001122764.1(PPOX): c.35T > C (p.Ile12Thr) | 28936677 | PPOX | [ ] | [ ] | ['Variegate porphyria'] |
| NM_000525.3(KCNJ11): c.440T > C (p.Leu147Pro) | 28936678 | KCNJ11 | [ ] | [ ] | ['Islet cell hyperplasia'] |
| NM_001025107.2(ADAR): c.1883T > C (p.Leu628Pro) | 28936680 | ADAR | [ ] | [ ] | ['Symmetrical dyschromatosis of extremities'] |
| NM_001025107.2(ADAR): c.2609T > C (p.Phe870Ser) | 28936681 | ADAR | [ ] | [ ] | ['Symmetrical dyschromatosis of extremities'] |
| NM_000557.4(GDF5): c.1322T > C (p.Leu441Pro) | 28936683 | — | [ ] | [ ] | ['Brachydactyly type A2', 'Fibular hypoplasia and complex brachydactyly'] |
| NM_000274.3(OAT): c.163T > C (p.Tyr55His) | 121965037 | OAT | [ ] | [ ] | ['Ornithine aminotransferase deficiency'] |
| NM_000274.3(OAT): c.1205T > C (p.Leu402Pro) | 121965043 | OAT | [ ] | [ ] | ['Ornithine aminotransferase deficiency'] |
| NM_000223.3(KRT12): c.386T > C (p.Met129Thr) | 28936695 | KRT12 | [ ] | [ ] | ['Meesman corneal dystrophy', 'not provided'] |
| NM_000128.3(F11): c.901T > C (p.Phe301Leu) | 121965064 | F11 | [ ] | ['TGATYTCTTGGG AGAAGAACTGG'] | ['Hereditary factor XI deficiency disease'] |
| NM_000128.3(F11): c.166T > C (p.Cys56Arg) | 121965069 | F11 | [ ] | [ ] | ['Hereditary factor XI deficiency disease'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000235.3(LIPA): c.599T > C (p.Leu200Pro) | 121965086 | LIPA | [ ] | [ ] | ['Lysosomal acid lipase deficiency'] |
| NM_001199.3(BMP1): c.*241T > C | 786205217 | BMP1 | [ ] | [ ] | ['Osteogenesis imperfecta type 13'] |
| NM_004974.3(KCNA2): c.788T > C (p.Ile263Thr) | 786205231 | KCNA2 | [ ] | [ ] | ['EPILEPTIC ENCEPHALOPATHY, EARLY INFANTILE, 32'] |
| NM_000548.3(TSC2): c.5150T > C (p.Leu1717Pro) | 45517398 | TSC2 | [ ] | ['GCCCYGCACGC AAATGTGAGTGG', 'CCCYGCACGCAA ATGTGAGTGG'] | ['Tuberous sclerosis syndrome', 'not provided'] |
| NM_000212.2(ITGB3): c.176T > C (p.Leu59Pro) | 5918 | ITGB3 | [ ] | [ ] | ['Myocardial infarction', 'Posttransfusion purpura', 'Thrombocytopenia, neonatal alloimmune', 'Fracture, hip, susceptible to'] |
| m.9191T > C | 386829069 | MT-ATP6 | [ ] | [ ] | ['Leigh disease'] |
| NM_000419.3(ITGA2B): c.1787T > C (p.Ile596Thr) | 76811038 | ITGA2B | [ ] | [ ] | ['Glanzmann thrombasthenia'] |
| NM_002294.2(LAMP2): c.864 + 2T > C | 730880485 | LAMP2 | [ ] | [ ] | ['Cardiomyopathy', 'Danon disease'] |
| NM_000138.4(FBN1): c.7111T > C (p.Trp2371Arg) | 794728264 | FBN1 | [ ] | [ ] | ['Thoracic aortic aneurysms and aortic dissections'] |
| NM_000531.5(OTC): c.143T > C (p.Phe48Ser) | 72554315 | OTC | [ ] | [ ] | ['not provided'] |
| NM_178454.4(DRAM2): c.79T > C (p.Tyr27His) | 786205662 | DRAM2 | [ ] | [ ] | ['Retinal dystrophy'] |
| NM_000138.4(FBN1): c.7531T > C (p.Cys2511Arg) | 794728272 | FBN1 | [ ] | [ ] | ['Thoracic aortic aneurysms and aortic dissections'] |
| NM_016218.2(POLK): c.609T > C (p.Asn203=) | 786205684 | POLK | [ ] | [ ] | ['Malignant tumor of prostate'] |
| NM_016218.2(POLK): c.*66T > C | 786205688 | POLK | [ ] | [ ] | ['Malignant tumor of prostate'] |
| NM_000354.5(SERPINA7): c.740T > C (p.Leu247Pro) | 28937312 | SERPINA7 | [ ] | [ ] | [ ] |
| NM_000531.5(OTC): c.284T > C (p.Leu95Ser) | 72554346 | OTC | ['ACAA GATYG TCTAC AGAAA CAGG'] | ['ACAAGATYGTCT ACAGAAACAGG'] | ['not provided'] |
| NM_015662.2(IFT172): c.770T > C (p.Leu257Pro) | 786205857 | IFT172 | [ ] | ['TTGTGCYAGGAA GTTATGACAGG'] | ['RETINITIS PIGMENTOSA 71'] |
| NM_000531.5(OTC): c.386 + 2T > C | 72554359 | OTC | [ ] | [ ] | ['not provided'] |
| NM_001135669.1(XPR1): c.434T > C (p.Leu145Pro) | 786205901 | XPR1 | [ ] | [ ] | ['BASAL GANGLIA CALCIFICATION, IDIOPATHIC, 6'] |
| NM_001135669.1(XPR1): c.419T > C (p.Leu140Pro) | 786205903 | XPR1 | [ ] | [ ] | ['BASAL GANGLIA CALCIFICATION, IDIOPATHIC, 6'] |
| NM_001135669.1(XPR1): c.653T > C (p.Leu218Ser) | 786205904 | XPR1 | [ ] | ['GCGTTYACGTGT CCCCCCTTTGG', 'CGTTYACGTGTC CCCCCTTTGGG'] | ['BASAL GANGLIA CALCIFICATION, IDIOPATHIC, 6'] |
| NM_181457.3(PAX3): c.268T > C (p.Tyr90His) | 104893654 | PAX3 | [ ] | [ ] | ['Klein-Waardenburg syndrome'] |
| NM_001987.4(ETV6): c.1046T > C | 786205155 | ETV6 | [ ] | [ ] | ['Thrombocytopenia', 'LEUKEMIA, |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Leu349Pro) | | | | | ['ACUTE LYMPHOBLASTIC; ALL'] |
| NM_000055.2(BCHE): c.1004T > C (p.Leu335Pro) | 104893684 | BCHE | [ ] | [ ] | ['Deficiency of butyrylcholine esterase'] |
| NM_000388.3(CASR): c.382T > C (p.Phe128Leu) | 104893696 | CASR | [ ] | [ ] | ['Hypocalcemia, autosomal dominant 1'] |
| NM_000388.3(CASR): c.1835T > C (p.Phe612Ser) | 104893698 | CASR | [ ] | [ ] | ['Hypocalcemia, autosomal dominant 1'] |
| NM_000388.3(CASR): c.2641T > C (p.Phe881Leu) | 104893704 | CASR | [ ] | ['ACGCTYTCAAGG TGGCTGCCCGG', 'CGCTYTCAAGGT GGCTGCCCGGG'] | ['Hypercalciuric hypercalcemia'] |
| NM_000388.3(CASR): c.374T > C (p.Leu125Pro) | 104893708 | CASR | [ ] | [ ] | ['Hypocalcemia, autosomal dominant 1', 'Hypocalcemia, autosomal dominant 1, with bartter syndrome'] |
| NM_000388.3(CASR): c.2362T > C (p.Phe788Leu) | 104893711 | CASR | [ ] | [ ] | ['Hypocalcemia, autosomal dominant 1'] |
| NM_000388.3(CASR): c.38T > C (p.Leu13Pro) | 104893717 | CASR | [ ] | [ ] | ['Hypocalciuric hypercalcemia, familial, type 1'] |
| NM_006580.3(CLDN16): c.500T > C (p.Leu167Pro) | 104893725 | CLDN16 | [ ] | [ ] | ['Primary hypomagnesemia'] |
| NM_006580.3(CLDN16): c.434T > C (p.Leu145Pro) | 104893731 | CLDN16 | [ ] | [ ] | ['Primary hypomagnesemia'] |
| NM_000041.3(APOE): c.388T > C (p.Cys130Arg) | 429358 | APOE | [ ] | [ ] | ['Familial type 3 hyperlipoproteinemia'] |
| NM_198159.2(MITF): c.1051T > C (p.Ser351Pro) | 104893744 | MITF | [ ] | [ ] | ['Waardenburg syndrome type 2A'] |
| NM_198159.2(MITF): c.1195T > C (p.Ser399Pro) | 104893747 | MITF | [ ] | ['ACTTYCCCTTAT TCCATCCACGG', 'CTTYCCCTTATTC CATCCACGGG'] | ['Waardenburg syndrome type 2A'] |
| NM_001122757.2(POU1F1): c.655T > C (p.Trp219Arg) | 104893758 | POU1F1 | [ ] | [ ] | ['Pituitary hormone deficiency, combined 1'] |
| NM_000539.3(RHO): c.133T > C (p.Phe45Leu) | 104893770 | RHO | [ ] | ['CATGYTTCTGCT GATCGTGCTGG', 'ATGYTTCTGCTG ATCGTGCTGGG'] | ['Retinitis pigmentosa 4'] |
| NM_003106.3(SOX2): c.290T > C (p.Leu97Pro) | 104893802 | — | [ ] | [ ] | ['Microphthalmia syndromic 3'] |
| NM_024009.2(GJB3): c.101T > C (p.Leu34Pro) | 28937583 | GJB3 | [ ] | [ ] | ['Erythrokeratodermia variabilis'] |
| NM_003907.2(EIF2B5): c.1882T > C (p.Trp628Arg) | 28937596 | EIF2B5 | [ ] | [AGGCCYGGAGC CCTGTTTTTAGG] | ['Leukoencephalopathy with vanishing white matter'] |
| NM_000551.3(VHL): c.188T > C (p.Leu63Pro) | 104893827 | VHL | [ ] | [ ] | ['Pheochromocytoma'] |
| NM_000320.2(QDPR): c.106T > C (p.Trp36Arg) | 104893865 | QDPR | [ ] | [ ] | ['Dihydropteridine reductase deficiency'] |
| NM_001151.3(SLC25A4): c.293T > C (p.Leu98Pro) | 104893876 | SLC25A4 | [ ] | ['GCAGCYCTTCTT AGGGGGTGTGG'] | ['Autosomal dominant progressive external ophthalmoplegia with mitochondrial DNA deletions 2'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006005.3(WFS1): c.2486T > C (p.Leu829Pro) | 104893883 | WFS1 | [ ] | ['ACCATCCYGGA GGGCCGCCTGGG'] | ['WFS1-Related Disorders'] |
| NM_001018077.1(NR3C1): c.1712T > C (p.Val571Ala) | 104893911 | NR3C1 | ['AAGY GATTG CAGCA GTGAA ATGG'] | ['AAGYGATTGCA GCAGTGAAATGG'] | ['Pseudohermaphroditism, female, with hypokalemia, due to glucocorticoid resistance'] |
| NM_001018077.1(NR3C1): c.2318T > C (p.Leu773Pro) | 104893912 | NR3C1 | [ ] | [ ] | ['Glucocorticoid resistance, generalized'] |
| NM_003122.4(SPINK1): c.2T > C (p.Met1Thr) | 104893938 | SPINK1 | [ ] | [ ] | ['Hereditary pancreatitis'] |
| NM_000165.4(GJA1): c.52T > C (p.Ser18Pro) | 104893962 | GJA1 | [ ] | ['CTACYCAACTGC TGGAGGGAAGG'] | ['Oculodentodigital dysplasia'] |
| NM_000416.2(IFNGR1): c.260T > C (p.Ile87Thr) | 104893973 | IFNGR1 | ['TGTA ATAYT TCTGA TCATG TTGG'] | ['TGTAATAYTTCT GATCATGTTGG'] | ['Disseminated atypical mycobacterial infection', 'Mycobacterium tuberculosis, susceptibility to'] |
| NM_000434.3(NEU1): c.718T > C (p.Trp240Arg) | 104893978 | NEU1 | [ ] | ['GCCTCCYGGCGC TACGGAAGTGG', 'CCTCCYGGCGCT ACGGAAGTGGG', 'CTCCYGGCGCTA CGGAAGTGGGG'] | ['Sialidosis, type II'] |
| NM_153704.5(TMEM67): c.755T > C (p.Met252Thr) | 202149403 | TMEM67 | [ ] | [ ] | ['Joubert syndrome 6'] |
| NM_000162.3(GCK): c.391T > C (p.Ser131Pro) | 104894010 | GCK | [ ] | [ ] | ['Maturity-onset diabetes of the young, type 2'] |
| NM_004577.3(PSPH): c.155T > C (p.Met52Thr) | 104894036 | PSPH | [ ] | [ ] | ['Deficiency of phosphoserine phosphatase'] |
| NM_000193.3(SHH): c.995T > C (p.Val332Ala) | 104894052 | SHH | [ ] | [ ] | ['Single upper central incisor'] |
| NM_000282.3(PCCA): c.491T > C (p.Ile164Thr) | 202247815 | PCCA | [ ] | [ ] | ['Propionic acidemia'] |
| NM_002546.3(TNFRSF11B): c.349T > C (p.Phe117Leu) | 104894092 | TNFRSF11B | [ ] | ['TAGAGYTCTGCT TGAAACATAGG'] | ['Hyperphosphatasemia with bone disease'] |
| NM_000532.4(PCCB): c.1556T > C (p.Leu519Pro) | 202247822 | PCCB | [ ] | [ ] | ['Propionic acidemia'] |
| NM_006412.3(AGPAT2): c.683T > C (p.Leu228Pro) | 104894100 | AGPAT2 | [ ] | [ ] | ['Congenital generalized lipodystrophy type 1'] |
| NM_000238.3(KCNH2): c.2366T > C (p.Ile789Thr) | 794728388 | KCNH2 | [ ] | [ ] | ['Cardiac arrhythmia'] |
| NM_001243133.1(NLRP3): c.1058T > C (p.Leu353Pro) | 28937896 | NLRP3 | [ ] | [ ] | ['Familial cold urticaria'] |
| NM_021020.3(LZTS1): c.85T > C (p.Ser29Pro) | 28937897 | LZTS1 | [ ] | [ ] | [ ] |
| NM_000102.3(CYP17A1): c.316T > C (p.Ser106Pro) | 104894135 | CYP17A1 | [ ] | ['CATCGCGYCCAA CAACCGTAAGG', 'ATCGCGYCCAAC AACCGTAAGGG'] | ['Complete combined 17-alpha-hydroxylase/17,20-lyase deficiency'] |
| NM_000102.3(CYP17A1): c.1216T > C (p.Trp406Arg) | 104894143 | CYP17A1 | [ ] | [ ] | ['Complete combined 17-alpha-hydroxylase/17,20-lyase deficiency'] |
| NM_000102.3(CYP17A1): c.1358T > C (p.Phe453Ser) | 104894151 | CYP17A1 | [ ] | ['AGCTCTYCCTCA TCATGGCCTGG'] | ['Combined partial 17-alpha-hydroxylase/17,20-lyase deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_005097.3(LGI1): c.136T > C (p.Cys46Arg) | 104894166 | LGI1 | [ ] | [ ] | ['Epilepsy, lateral temporal lobe, autosomal dominant'] |
| NM_005097.3(LGI1): c.695T > C (p.Leu232Pro) | 104894167 | LGI1 | [ ] | [ ] | ['Epilepsy, lateral temporal lobe, autosomal dominant'] |
| NM_000281.3(PCBD1): c.244T > C (p.Cys82Arg) | 104894177 | PCBD1 | [ ] | [ ] | ['Hyperphenylalaninemia, BH4-deficient, D'] |
| NM_003476.4(CSRP3): c.131T > C (p.Leu44Pro) | 104894205 | CSRP3 | [ ] | [ ] | ['Familial hypertrophic cardiomyopathy 12', 'not specified'] |
| NM_000315.2(PTH):c. 67T > C (p.Ser23Pro) | 104894272 | PTH | [ ] | [ ] | ['Hypoparathyroidism familial isolated'] |
| NM_005055.4(RAPSN): c.848T > C (p.Leu283Pro) | 104894293 | RAPSN | [ ] | [ ] | ['Myasthenic syndrome, congenital, associated with acetylcholine receptor deficiency', 'MYASTHENIC SYNDROME, CONGENITAL, 11, ASSOCIATED WITH ACETYLCHOLINE RECEPTOR DEFICIENCY'] |
| NM_000518.4(HBB):c. 344T > C (p.Leu115Pro) | 36015961 | HBB | [ ] | [IGTGTGCYGGCC CATCACTTTGG'] | ['Beta thalassemia intermedia'] |
| NM_005055.4(RAPSN): c.41T > C (p.Leu14Pro) | 104894300 | RAPSN | [ ] | [ ] | ['MYASTHENIC SYNDROME, CONGENITAL, 11, ASSOCIATED WITH ACETYLCHOLINE RECEPTOR DEFICIENCY'] |
| NM_000531.5(OTC):c. 2T > C (p.Met1Thr) | 72552295 | OTC | ['AGAA GAYGC TGTTT AATCT GAGG'] | ['AGAAGAYGCTG TTTAATCTGAGG'] | ['not provided'] |
| NM_020661.2(AICDA): c.238T > C (p.Trp80Arg) | 104894320 | AICDA | [ ] | [ ] | ['Immunodeficiency with hyper IgM type 2'] |
| NM_020661.2(AICDA): c.317T > C (p.Leu106Pro) | 104894321 | AICDA | [ ] | [ ] | ['Immunodeficiency with hyper IgM type 2'] |
| NM_020661.2(AICDA): c.452T > C (p.Phe151Ser) | 104894327 | AICDA | [ ] | [ ] | ['Immunodeficiency with hyper IgM type 2'] |
| NM_000486.5(AQP2): c.646T > C (p.Ser216Pro) | 104894329 | — | [ ] | [ ] | [ ] |
| NM_020638.2(FGF23): c.287T > C (p.Met96Thr) | 104894343 | FGF23 | [ ] | [ ] | ['Tumoral calcinosis, familial, hyperphosphatemic'] |
| NM_021044.2(DHH):c. 2T > C (p.Met1Thr) | 104894346 | DHH | [ ] | [ ] | ['46,XY gonadal dysgenesis, partial, with minifascicular neuropathy'] |
| NM_000217.2(KCNA1): c.1223T > C (p.Val408Ala) | 104894352 | KCNA1 | [ ] | [ ] | ['Episodic ataxia type 1'] |
| NM_000432.3(MYL2): c.52T > C (p.Phe18Leu) | 104894370 | MYL2 | [ ] | [ ] | ['Familial hypertrophic cardiomyopathy 10'] |
| NM_080911.2(UNG):c. | 104894380 | UNG | [ ] | [ ] | ['Immunodeficiency |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| 752T > C (p.Phe251Ser) | | | | | with hyper IgM type 5'] |
| NM_000192.3(TBX5): c.161T > C (p.Ile54Thr) | 104894384 | TBX5 | [ ] | [ ] | ['Holt-Oram syndrome'] |
| NM_175929.2(FGF14): c.449T > C (p.Phe150Ser) | 104894393 | FGF14 | [ ] | [ ] | ['Spinocerebellar ataxia 27'] |
| NM_007262.4(PARK7): c.497T > C (p.Leu166Pro) | 28938172 | PARK7 | [ ] | [ ] | ['Parkinson disease 7'] |
| NM_004004.5(GJB2): c.229T > C (p.Trp77Arg) | 104894397 | GJB2 | [ ] | [ ] | ['Deafness, autosomal recessive 1A', 'not provided'] |
| NM_001130089.1(KARS): c.517T > C (p.Tyr173His) | 397514745 | KARS | ['TTCYATGATCTTCGAGGAGAGGG'] | ['CTTCYATGATCTTCGAGGAGAGG', 'TTCYATGATCTTCGAGGAGAGGG'] | ['Deafness, autosomal recessive 89'] |
| NM_000161.2(GCH1): c.662T > C (p.Met221Thr) | 104894434 | GCH1 | [ ] | [ ] | ['Dystonia, dopa-responsive, with or without hyperphenylalaninemia, autosomal recessive'] |
| NM_032409.2(PINK1): c.1040T > C (p.Leu347Pro) | 28940285 | — | [ ] | [ ] | ['Parkinson disease 6, autosomal recessive early-onset'] |
| NM_006177.3(NRL): c.479T > C (p.Leu160Pro) | 104894463 | NRL | [ ] | [ ] | ['Retinal degeneration, autosomal recessive, clumped pigment type'] |
| NM_152443.2(RDH12): c.523T > C (p.Ser175Pro) | 104894472 | RDH12 | [ ] | [ICCYCGGTGGCTCACCACATTGG] | ['Leber congenital amaurosis 13'] |
| NM_002435.2(MPI): c.413T > C (p.Met138Thr) | 104894495 | MPI | [ ] | [ ] | ['Congenital disorder of glycosylation type 1B'] |
| NM_001159702.2(FHL1): c.457T > C (p.Cys153Arg) | 122458144 | FHL1 | [ ] | [ ] | ['Myopathy, reducing body, X-linked, childhood-onset'] |
| NM_183235.2(RAB27A): c.389T > C (p.Leu130Pro) | 104894498 | RAB27A | [ ] | [ ] | ['Griscelli syndrome type 2'] |
| NM_001018005.1(TPM1): c.284T > C (p.Val95Ala) | 104894504 | TPM1 | [ ] | [ ] | ['Familial hypertrophic cardiomyopathy 3', 'Cardiomyopathy'] |
| NM_000485.2(APRT): c.329T > C (p.Leu110Pro) | 104894508 | APRT | [ ] | [ ] | ['Adenine phosphoribosyltransferase deficiency'] |
| NM_000303.2(PMM2): c.131T > C (p.Val44Ala) | 104894534 | PMM2 | [ ] | [ ] | ['Carbohydrate-deficient glycoprotein syndrome type I'] |
| NM_024006.5(VKORC1): c.134T > C (p.Val45Ala) | 104894540 | VKORC1 | [ ] | [ ] | ['Warfarin response'] |
| NM_001614.3(ACTG1): c.1109T > C (p.Val370Ala) | 104894547 | ACTG1 | [ ] | [ ] | ['Deafness, autosomal dominant 20'] |
| NM_001128085.1(ASPA): c.454T > C (p.Cys152Arg) | 104894548 | — | [ ] | [ ] | ['Spongy degeneration of central nervous system'] |
| NM_004870.3(MPDU1): c.356T > C (p.Leu119Pro) | 104894587 | MPDU1 | [ ] | ['TCCYGGTCATGCACTACAGAGG'] | ['Congenital disorder of glycosylation type 1F'] |
| NM_004870.3(MPDU1): c.2T > C (p.Met1Thr) | 104894588 | MPDU1 | [ ] | ['AATAYGGCGGCCGAGGCGGACGG'] | ['Congenital disorder of glycosylation type 1F'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_004870.3(MPDU1): c.221T > C (p.Leu74Ser) | 104894589 | MPDU1 | [ ] | [ ] | ['Congenital disorder of glycosylation type 1F'] |
| NM_153006.2(NAGS): c.1289T > C (p.Leu430Pro) | 104894605 | — | [ ] | [ ] | ['Hyperammonemia, type III'] |
| NM_000304.3(PMP22): c.47T > C (p.Leu16Pro) | 104894617 | PMP22 | [ ] | [ ] | [Charcot-Marie-Tooth disease, type IA'] |
| NM_000304.3(PMP22): c.82T > C (p.Trp28Arg) | 104894626 | PMP22 | [ ] | [TAGCAAYGGAT CGTGGGCAATGG'] | [Charcot-Marie-Tooth disease, type IE'] |
| NM_018129.3(PNPO): c.784T > C (p.Ter262Gln) | 104894631 | PNPO | [ ] | [ACCTYAACTCTG GGACCTGCTGG'] | ["Pyridoxal 5'-phosphate-dependent epilepsy"] |
| NM_173477.4(USH1G): c.143T > C (p.Leu48Pro) | 104894651 | USH1G | [ ] | [ ] | ['Usher syndrome, type 1G'] |
| NM_000371.3(TTR):c. 191T > C (p.Phe64Ser) | 104894665 | TTR | [ ] | [ ] | ['Amyloidogenic transthyretin amyloidosis', 'AMYLOIDOSIS, LEPTOMENINGEAL, TRANSTHYRETIN-RELATED'] |
| NM_024301.4(FKRP): c.899T > C (p.Val300Ala) | 104894691 | FKRP | [ ] | [ ] | ['Limb-girdle muscular dystrophy-dystroglycanopathy, type C5'] |
| NM_032551.4(KISS1R): c.305T > C (p.Leu102Pro) | 104894703 | KISS1R | [ ] | ['GCCCTGCYGTAC CCGCTGCCCGG', 'TGCYGTACCCGC TGCCCGGCTGG'] | [ ] |
| NM_000660.5(TGFB1): c.673T > C (p.Cys225Arg) | 104894719 | TGFB1 | [ ] | [ ] | ['Diaphyseal dysplasia'] |
| NM_000229.1(LCAT): c.524-22T > C | 794726664 | LCAT | [ ] | [ ] | ['Fish-eye disease'] |
| NM_003332.3(TYROBP): c.2T > C (p.Met1Thr) | 104894732 | TYROBP | [ ] | [ ] | ['Polycystic lipomembranous osteodysplasia with sclerosing leukoencephalopathy'] |
| NM_000074.2(CD40LG): c.464T > C (p.Leu155Pro) | 104894769 | CD40LG | [ ] | [ ] | ['Immunodeficiency with hyper IgM type 1'] |
| NM_000495.4(COL4A5): c.438 + 2T > C | 281874738 | COL4A5 | ['TCCA GYAAG TTATA AAATT TGGG'] | ['CTCCAGYAAGTT ATAAAATTTGG', 'TCCAGYAAGTTA TAAAATTTGGG'] | ['Alport syndrome, X-linked recessive'] |
| NM_000495.4(COL4A5): c.4690T > C (p.Cys1564Arg) | 281874745 | COL4A5 | [ ] | [ ] | ['Alport syndrome, X-linked recessive'] |
| NM_178152.2(DCX):c. 373T > C (p.Tyr125His) | 104894781 | DCX | [ ] | [ ] | ['Lissencephaly, X-linked', 'Subcortical laminar heterotopia, X-linked'] |
| NM_006579.2(EBP):c. 53T > C (p.Leu18Pro) | 104894795 | EBP | [ ] | [ ] | ['MEND SYNDROME'] |
| NM_001097642.2(GJB1): c.397T > C (p.Trp133Arg) | 104894813 | GJB1 | [ ] | [ ] | ['X-linked hereditary motor and sensory neuropathy'] |
| NM_001165963.1(SCN1A): c.2690T > C (p.Leu897Ser) | 794726761 | SCN1A | [ ] | [ ] | ['Severe myoclonic epilepsy in infancy'] |
| NM_000166.5(GJB1): c.407T > C (p.Val136Ala) | 104894826 | GJB1 | [ ] | ['ATGYCATCAGCG TGGTGTTCCGG'] | ['Dejerine-Sottas disease', 'X-linked hereditary motor and sensory neuropathy'] |
| NM_001165963.1(SCN1A): c.769T > C (p.Cys257Arg) | 794726771 | SCN1A | [ ] | [ ] | ['Severe myoclonic epilepsy in infancy', 'not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001165963.1(SCN1A): c.1033T > C (p.Cys345Arg) | 794726782 | SCN1A | [ ] | [ ] | ['Severe myoclonic epilepsy in infancy'] |
| NM_001122606.1(LAMP2): c.961T > C (p.Trp321Arg) | 104894859 | LAMP2 | [ ] | [CAGCTACYGGG ATGCCCCCTGG', 'AGCTACYGGGAT GCCCCCCTGGG'] | ['Danon disease'] |
| m.10237T > C | 193302927 | MT-ND3 | [ ] | [ ] | ['Leber optic atrophy'] |
| NM_033290.3(MID1): c.884T > C (p.Leu295Pro) | 104894866 | MID1 | [ ] | [ ] | ['Opitz-Frias syndrome'] |
| m.10663T > C | 193302933 | MT-ND4L | [ ] | [ ] | ['Leber optic atrophy'] |
| NM_001165963.1(SCN1A):c .4055T > C (p.Leu1352Pro) | 794726821 | — | ['TTCYG GTTTG TCTTAT ATTCT GG'] | ['TTCYGGTTTGTC TTATATTCTGG'] | ['Severe myoclonic epilepsy in infancy'] |
| NM_000475.4(NR0B1): c.890T > C (p.Leu297Pro) | 104894907 | NR0B1 | [ ] | [ ] | ['Congenital adrenal hypoplasia, X-linked'] |
| NM_022567.2(NYX): c.302T > C (p.Ile101Thr) | 104894911 | NYX | [ ] | [ ] | ['Congenital stationary night blindness, type 1A'] |
| NM_000513.2(OPN1MW): c.607T > C (p.Cys203Arg) | 104894914 | OPN1MW | [ ] | [ ] | ['Colorblindness, partial, deutan series', 'Cone monochromatism'] |
| NM_006517.4(SLC16A2): c.1313T > C (p.Leu438Pro) | 104894931 | SLC16A2 | [ ] | ['TGAGCYGGTGG GCCCAATGCAGG'] | ['Allan-Herndon-Dudley syndrome'] |
| NM_000330.3(RS1):c. 38T > C (p.Leu13Pro) | 104894935 | RS1 | [ ] | ['TTACTTCYCTTT GGCTATGAAGG'] | ['Juvenile retinoschisis', 'not provided'] |
| NM_000116.4(TAZ):c. 352T > C (p.Cys118Arg) | 104894937 | TAZ | ['AAGY GTGTG CCTGT GTGCC GAGG'] | ['AAGYGTGTGCCT GTGTGCCGAGG'] | ['3-Methylglutaconic aciduria type 2'] |
| NM_006517.4(SLC16A2): c.1481T > C (p.Leu494Pro) | 104894938 | SLC16A2 | [ ] | [ ] | ['Allan-Herndon-Dudley syndrome'] |
| NM_001109878.1(TBX22): c.641T > C (p.Leu214Pro) | 104894946 | TBX22 | [ ] | [ ] | ['Cleft palate with ankyloglossia'] |
| NM_001011658.3(TRAPPC2): c.248T > C (p.Phe83Ser) | 104894948 | — | [ ] | [ ] | ['Spondyloepiphyseal dysplasia tarda'] |
| NM_003140.2(SRY):c. 326T > C (p.Phe109Ser) | 104894956 | SRY | [ ] | [ ] | ['46,XY sex reversal, type 1'] |
| NM_003140.2(SRY):c. 203T > C (p.Ile68Thr) | 104894968 | SRY | [ ] | [ ] | ['46,XY sex reversal, type 1'] |
| NM_201269.2(ZNF644): c.1759A > G (p.Ile587Val) | 146936371 | ZNF644 | [ ] | [ ] | ['Myopia 21, autosomal dominant'] |
| NM_001004434.2(SLC30A2): c.161A > G (p.His54Arg) | 587776926 | SLC30A2 | [ ] | [ ] | ['Reduced zinc in breast milk'] |
| NM_000492.3(CFTR): c.3469-20T > C | 373002889 | CFTR | [ ] | [ ] | ['Cystic fibrosis'] |
| NM_001848.2(COL6A1): c.957 + 2T > C | 794727060 | COL6A1 | ['ACAA GGYGA GCGTG GGCTG CTGG', 'CAAGG YGAGC GTGGG CTGCT GGG'] | ['ACAAGGYGAGC GTGGGCTGCTGG', 'CAAGGYGAGCGT GGGCTGCTGGG'] | ['Ullrich congenital muscular dystrophy', 'Bethlem myopathy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| m.4336T > C | 41456348 | MT-TQ | [ ] | [ ] | [ ] |
| NM_001065.3(TNFRSF1A): c.175T > C (p.Cys59Arg) | 104895217 | TNFRSF1A | [ ] | ['TGCYGTACCAAG TGCCACAAAGG'] | ['TNF receptor-associated periodic fever syndrome (TRAPS)'] |
| NM_003072.3(SMARCA4): c.3032T > C (p.Met1011Thr) | 281875229 | SMARCA4 | [ ] | [ ] | ['Mental retardation, autosomal dominant 16', 'not provided'] |
| NM_019885.3(CYP26B1): c.436T > C (p.Ser146Pro) | 281875232 | CYP26B1 | [ ] | [ ] | ['Radiohumeral fusions with other skeletal and craniofacial anomalies', 'not provided'] |
| NM_000182.4(HADHA): c.180 + 3A > G | 781222705 | HADHA | [ ] | [ ] | ['Mitochondrial trifunctional protein deficiency', 'Long-chain 3-hydroxyacyl-CoA dehydrogenase deficiency', 'not provided'] |
| NM_000208.2(INSR): c.1124-2A > G | 587776819 | INSR | [ ] | [ ] | ['Pineal hyperplasia AND diabetes mellitus syndrome'] |
| NM_006329.3(FBLN5): c.506T > C (p.Ile169Thr) | 28939072 | FBLN5 | ['GACAYTGAT GAATG TCGCT ATGG'] | ['GACAYTGATGA ATGTCGCTATGG'] | ['Age-related macular degeneration 3'] |
| NM_000431.3(MVK): c.803T > C (p.Ile268Thr) | 104895304 | MVK | ['CTCA AYAGA TGCCA TCTCC CTGG'] | ['CTCAAYAGATGC CATCTCCCTGG'] | ['Hyperimmunoglobulin D with periodic fever', 'Mevalonic aciduria'] |
| NM_024960.4(PANK2): c.437T > C (p.Met146Thr) | 28939088 | PANK2 | [ ] | [ ] | ['Hypoprebetalipo-proteinemia, acanthocytosis, retinitis pigmentosa, and pallidal degeneration'] |
| NM_005359.5(SMAD4): c.1499T > C (p.Ile500Thr) | 281875321 | SMAD4 | [ ] | [ ] | ['Myhre syndrome', 'not provided'] |
| NM_003793.3(CTSF): c.692A > G (p.Tyr231Cys) | 143889283 | CTSF | [ ] | ['CTCCAYACTGAG CTGTGCCACGG'] | ['Ceroid lipofuscinosis, neuronal, 13'] |
| NM_001159702.2(FHL1): c.310T > C (p.Cys104Arg) | 122459147 | FHL1 | [ ] | ['GGGGYGCTTCA AGGCCATTGTGG'] | ['Myopathy, reducing body, X-linked, childhood-onset'] |
| NM_001159702.2(FHL1): c.625T > C (p.Cys209Arg) | 122459149 | FHL1 | [ ] | [ ] | ['Emery-dreifuss muscular dystrophy 6'] |
| NM_006214.3(PHYH): c.135-2A > G | 201578674 | PHYH | [ ] | [ ] | ['Refsum disease, adult, 1'] |
| NM_006329.3(FBLN5): c.679T > C (p.Ser227Pro) | 28939370 | FBLN5 | [ ] | [ ] | ['Autosomal recessive cutis laxa type IA'] |
| NM_004329.2(BMPR1A): c.1409T > C (p.Met470Thr) | 199476089 | BMPR1A | [ ] | [ ] | ['Juvenile polyposis syndrome'] |
| NM_005154.4(USP8): c.2152T > C (p.Ser718Pro) | 672601307 | USP8 | [ ] | [ ] | ['Pituitary dependent hypercortisolism'] |
| NM_020184.3(CNNM4): c.971T > C (p.Leu324Pro) | 74552543 | CNNM4 | [ ] | ['AAGCTCCYGGA CTTTTTTCTGGG'] | ['Cone-rod dystrophy amelogenesis imperfecta'] |
| NM_000734.3(CD247): c.2T > C (p.Met1Thr) | 672601318 | CD247 | [ ] | [ ] | ['Immunodeficiency due to defect in cd3-zeta'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_016042.3(EXOSC3): c.712T > C (p.Trp238Arg) | 672601332 | EXOSC3 | [ ] | [ ] | ['Pontocerebellar hypoplasia, type 1b'] |
| NC_012920.1:m.14484T > C | 199476104 | MT-ND6 | [ ] | [ ] | ['Leber optic atrophy', 'Leigh disease'] |
| m.10158T > C | 199476117 | MT-ND3 | [ ] | ['AAAYCCACCCCT TACGAGTGCGG'] | ['Leigh disease', 'Leigh syndrome due to mitochondrial complex I deficiency', 'Mitochondrial complex I deficiency'] |
| NM_020451.2(SEPN1): c.872 + 2T > C | 794727808 | SEPN1 | [ ] | ['TCCGGYGAGTG GGCCACACTGG'] | ['Congenital myopathy with fiber type disproportion', 'Eichsfeld type congenital muscular dystrophy'] |
| NM_005022.3(PFN1): c.350A > G (p.Glu117Gly) | 140547520 | PFN1 | [ ] | ['CACCTYCTTTGC CCATCAGCAGG'] | ['Amyotrophic lateral sclerosis 18'] |
| NM_032551.4(KISS1R): c.443T > C (p.Leu148Ser) | 28939719 | KISS1R | [ ] | [ ] | [ ] |
| NM_000084.4(CLCN5): c.674T > C (p.Leu225Pro) | 273585645 | CLCN5 | [ ] | [ ] | ['Dent disease 1'] |
| NM_000030.2(AGXT): c.605T > A (p.Ile202Asn) | 536352238 | AGXT | [ ] | [ ] | ['Primary hyperoxaluria, type I'] |
| NM_000060.3(BTD): c.212T > C (p.Leu71Pro) | 397514333 | BTD | [ ] | [ ] | ['Biotinidase deficiency'] |
| NM_000060.3(BTD): c.248T > C (p.Leu83Ser) | 397514347 | BTD | [ ] | [ ] | ['Biotinidase deficiency'] |
| NM_000060.3(BTD): c.445T > C (p.Phe149Leu) | 397514359 | BTD | [ ] | ['TCACCGCYTCAA TGACACAGAGG'] | ['Biotinidase deficiency'] |
| NM_000060.3(BTD): c.743T > C (p.Ile248Thr) | 397514382 | BTD | [ ] | [ ] | ['Biotinidase deficiency'] |
| NM_000060.3(BTD): c.764T > C (p.Ile255Thr) | 397514384 | BTD | [ ] | [ ] | ['Biotinidase deficiency'] |
| NM_000060.3(BTD): c.833T > C (p.Leu278Pro) | 397514389 | BTD | [ ] | [ ] | ['Biotinidase deficiency'] |
| NM_000061.3(BTK): c.2T > C (p.Met1Thr) | 128620186 | BTK | ['AGCT AYGGC CGCAG TGATT CTGG'] | ['AGCTAYGGCCG CAGTGATTCTGG'] | ['X-linked agammaglobulinemia'] |
| m.15572T > C | 207459996 | MT-CYB | [ ] | [ ] | ['Familial colorectal cancer'] |
| NM_000060.3(BTD): c.1096T > C (p.Ser366Pro) | 397514399 | BTD | [ ] | [ ] | ['Biotinidase deficiency'] |
| m.15197T > C | 207460001 | MT-CYB | [ ] | ['CTAYCCGCCATC CCATACATTGG'] | ['Exercise intolerance'] |
| m.14849T > C | 207460004 | MT-CYB | [ ] | [ ] | [ ] |
| NM_000060.3(BTD): c.1214T > C (p.Leu405Pro) | 397514406 | BTD | [ ] | ['TTCACCCYGGTC CCTGTCTGGGG'] | ['Biotinidase deficiency'] |
| NM_000060.3(BTD): c.1252T > C (p.Cys418Arg) | 397514408 | BTD | [ ] | [ ] | ['Biotinidase deficiency'] |
| NM_000060.3(BTD): c.1267T > C (p.Cys423Arg) | 397514412 | BTD | [ ] | [ ] | ['Biotinidase deficiency'] |
| NM_001128177.1(THRB): c.1336T > C (p.Cys446Arg) | 121918703 | THRB | [ ] | [ ] | ['Thyroid hormone resistance, generalized, autosomal dominant'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
| --- | --- | --- | --- | --- | --- |
| NM_000060.3(BTD): c.1459T > C (p.Trp487Arg) | 397514422 | BTD | [ ] | [ ] | ['Biotinidase deficiency'] |
| NM_198056.2(SCN5A): c.3963 + 2T > C | 397514447 | SCN5A | [ ] | [ ] | ['Progressive familial heart block type 1A'] |
| NM_020461.3(TUBGCP6): c.2546A > G (p.Glu849Gly) | 368449236 | TUBGCP6 | [ ] | [ ] | ['Microcephaly with chorioretinopathy, autosomal recessive'] |
| NM_006225.3 (PLCD1): c.562T > C (p.Cys188Arg) | 397514471 | PLCD1 | [ ] | [ ] | ['Leukonychia totalis'] |
| NM_001161581.1(POC1A): c.398T > C (p.Leu133Pro) | 397514488 | POC1A | ['AGCYGTGGGACAAGAGCAGCCGG'] | ['AGCYGTGGGACAAGAGCAGCCGG'] | ['Short stature, onychodysplasia, facial dysmorphism, and hypotrichosis'] |
| NM_005340.6(HINT1): c.250T > C (p.Cys84Arg) | 397514489 | HINT1 | ['CAAGAAAYGTGCTGCTGATCTGG', 'AAGAAAYGTGCTGATCTGGG'] | ['CAAGAAAYGTGCTGCTGATCTGG', 'AAGAAAYGTGCTGCTGATCTGGG'] | ['Gamstorp-Wohlfart syndrome'] |
| NM_000051.3(ATM): c.2T > C (p.Met1Thr) | 786203606 | ATM | [ ] | [ ] | ['Ataxia-telangiectasia syndrome', 'Hereditary cancer-predisposing syndrome'] |
| NM_004281.3(BAG3): c.1385T > C (p.Leu462Pro) | 397514507 | BAG3 | [ ] | [ ] | ['Dilated cardiomyopathy 1HH'] |
| NM_183075.2(CYP2U1): c.784T > C (p.Cys262Arg) | 397514515 | CYP2U1 | [ ] | [ ] | ['Spastic paraplegia 56, autosomal recessive'] |
| NM_006177.3(NRL): c.287T > C (p.Met96Thr) | 397514516 | NRL | [ ] | MAGGCCAYGGAGCTGCTGCAGGG'] | ['Retinitis pigmentosa 27'] |
| NM_000344.3(SMN1): c.388T > C (p.Tyr130His) | 397514518 | SMN1 | ['CACTGGAYATGGAAATAGAGAGG'] | ['CACTGGAYATGGAAATAGAGAGG'] | ['Kugelberg-Welander disease'] |
| NM_152692.4(C1GALT1C1): c.577T > C (p.Ser193Pro) | 397514537 | C1GALT1C1 | [ ] | [ ] | ['Polyagglutinable erythrocyte syndrome'] |
| NM_024531.4(SLC52A2): c.368T > C (p.Leu123Pro) | 397514538 | SLC52A2 | [ ] | [ ] | [Brown-Vialetto-Van Laere syndrome 2'] |
| NM_000138.4(FBN1): c.5746T > C (p.Cys1916Arg) | 794728238 | FBN1 | [ ] | [ ] | ['Thoracic aortic aneurysms and aortic dissections'] |
| NM_000138.4(FBN1): c.6274T > C (p.Trp2092Arg) | 794728246 | FBN1 | [ ] | [ ] | ['Thoracic aortic aneurysms and aortic dissections'] |
| NM_017802.3(DNAAF5): c.2384T > C (p.Leu795Pro) | 397514561 | DNAAF5 | [ ] | [ ] | ['Ciliary dyskinesia, primary, 18'] |
| NM_206933.2(USH2A): c.12295-2A > G | 151148854 | USH2A | [ ] | [ ] | ['Usher syndrome, type 2A'] |
| NM_000531.5 (OTC): c.134T > C (p.Leu45Pro) | 72554312 | OTC | [ ] | ['CTCACTCYAAAAAACTTTACCGG'] | ['Ornithine carbamoyltransferase deficiency', 'not provided'] |
| NM_178012.4(TUBB2B): c.350T > C (p.Leu117Pro) | 397514569 | TUBB2B | [ ] | ['GGTCCYGGATGTGGTGAGGAAGG'] | ['Polymicrogyria, asymmetric'] |
| NM_000431.3(MVK): c.764T > C | 397514570 | MVK | [ ] | [ ] | ['Porokeratosis, disseminated |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Leu255Pro) | | | | | superficial actinic 1'] |
| NM_000431.3(MVK): c.122T > C (p.Leu41Pro) | 397514571 | MVK | [ ] | ['CGGCYTCAACCCC CACAGCAATGG', 'GGCYTCAACCCC ACAGCAATGGG'] | ['Porokeratosis, disseminated superficial actinic 1'] |
| NM_000531.5 (OTC): c.167T > C (p.Met56Thr) | 72554320 | OTC | [ ] | [ ] | ['not provided'] |
| NM_000531.5 (OTC): c.188T > C (p.Leu63Pro) | 72554324 | OTC | [ ] | [ ] | ['not provided'] |
| NM_000531.5 (OTC): c.227T > C (p.Leu76Ser) | 72554328 | OTC | [ ] | [ ] | ['not provided'] |
| NM_004055.4(CAPN5): c.731T > C (p.Leu244Pro) | 397514602 | CAPN5 | [ ] | [ ] | ['Vitreoretinopathy, neovascular inflammatory'] |
| NM_133497.3(KCNV2): c.491T > C (p.Phe164Ser) | 397514604 | KCNV2 | [ ] | [ ] | ['Retinal cone dystrophy 3B'] |
| NM_006567.3(FARS2): c.986T > C (p.Ile329Thr) | 397514611 | FARS2 | [ ] | [ ] | ['Combined oxidative phosphorylation deficiency 14'] |
| NM_018344.5(SLC29A3): c.607T > C (p.Ser203Pro) | 397514626 | SLC29A3 | ['ACTG ATAYC AGGTG AGAGC CAGG'] | ['ACTGATAYCAG GTGAGAGCCAGG', 'CTGATAYCAGGT GAGAGCCAGGG'] | ['Histiocytosis-lymphadenopathy plus syndrome'] |
| NM_000108.4(DLD): c.140T > C (p.Ile47Thr) | 397514651 | DLD | ['ACAG TTAYA GGTTC TGGTC CTGG', 'GTTAY AGGTT CTGGT CCTGG AGG'] | ['ACAGTTAYAGGT TCTGGTCCTGG', 'GTTAYAGGTTCT GGTCCTGGAGG'] | ['Maple syrup urine disease, type 3'] |
| NM_020632.2(ATP6V0A4): c.1739T > C (p.Met580Thr) | 3807153 | ATP6V0A4 | [ ] | [ ] | ['Renal tubular acidosis, distal, autosomal recessive'] |
| NM_000238.3(KCNH2): c.1945 + 6T > C | 794728380 | KCNH2 | ['CTGTG AGYGT GCCCA GGGGC GGG', 'TGAGY GTGCC CAGGG GCGGG CGG'] | ['CTGTGAGYGTGC CCAGGGGCGGG', 'TGAGYGTGCCCA GGGGCGGGCGG'] | ['Cardiac arrhythmia'] |
| NM_001033053.2(NLRP1): c.230T > C (p.Met77Thr) | 397514692 | NLRP1 | [ ] | [ ] | ['Corneal intraepithelial dyskeratosis and ectodermal dysplasia'] |
| NM_000238.3(KCNH2): c.2396T > C (p.Leu799Pro) | 794728390 | KCNH2 | [ ] | ['GCCATCCYGGGT ATGGGGTGGGG', 'CCATCCYGGGTA TGGGGTGGGGG', 'CATCCYGGGTAT GGGGTGGGGGG'] | ['Cardiac arrhythmia'] |
| NM_014845.5(FIG4): c.524T > C (p.Leu175Pro) | 397514707 | FIG4 | [ ] | [ ] | ['Yunis Varon syndrome'] |
| NM_001199107.1(TBC1D24): c.686T > C (p.Phe229Ser) | 397514713 | TBC1D24 | [ ] | ['GGTCTYTGACGT CTTCCTGGTGG'] | ['Early infantile epileptic encephalopathy 16'] |
| NM_080605.3(B3GALT6): c.193A > G (p.Ser65Gly) | 397514719 | B3GALT6 | [ ] | ['CGCYGGCCACC AGCACTGCCAGG'] | ['Spondyloepimetap hyseal dysplasia with joint laxity'] |
| NM_004183.3(BEST1): c.253T > C (p.Tyr85His) | 28940274 | BEST1 | [ ] | [ ] | ['Vitelliform dystrophy', 'not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_005689.2(ABCB6): c.1067T > C (p.Leu356Pro) | 397514756 | ABCB6 | [ ] | [ ] | ['Dyschromatosis universalis hereditaria 3'] |
| NM_000551.3(VHL): c.488T > C (p.Leu163Pro) | 28940297 | VHL | [ ] | [ ] | [ ] |
| NM_000218.2(KCNQ1): c.1025T > C (p.Leu342Pro) | 794728522 | KCNQ1 | [ ] | [ ] | ['Cardiac arrhythmia'] |
| NM_000218.2(KCNQ1): c.1251 + 2T > C | 794728528 | KCNQ1 | [ ] | [ ] | ['Cardiac arrhythmia'] |
| NM_000498.3(CYP11B2): c.1382T > C (p.Leu461Pro) | 72554627 | — | [ ] | [ ] | ['Corticosterone methyloxidase type 1 deficiency'] |
| NM_130799.2(MEN1): c.547T > C (p.Trp183Arg) | 794728649 | MEN1 | [ ] | [ ] | ['not provided'] |
| NM_213653.3(HFE2): c.238T > C (p.Cys80Arg) | 28940586 | HFE2 | [ ] | [ ] | ['Hemochromatosis type 2A'] |
| NM_198056.2(SCN5A): c.4299 + 6T > C | 794728934 | SCN5A | [ ] | [ ] | ['not provided'] |
| NM_000548.3(TSC2): c.1946 + 2T > C | 397515247 | TSC2 | [ ] | [ ] | ['Tuberous sclerosis syndrome'] |
| NM_000256.3(MYBPC3): c.3796T > C (p.Cys1266Arg) | 730880608 | MYBPC3 | [ ] | MAGYGCCGCCT GGAGGTGCGAGG'] | ['Cardiomyopathy'] |
| NM_016381.5(TREX1): c.530T > C (p.Val177Ala) | 79993407 | TREX1 | [ ] | [ ] | ['Aicardi Goutieres syndrome 1'] |
| NM_001382.3(DPAGT1): c.503T > C (p.Leu168Pro) | 397515329 | DPAGT1 | [ ] | ['AATCCYGTACTA TGTCTACATGG', 'ATCCYGTACTAT GTCTACATGGG', 'TCCYGTACTATG TCTACATGGGG'] | ['Congenital disorder of glycosylation type 1J'] |
| NM_000372.4(TYR): c.265T > C (p.Cys89Arg) | 28940877 | TYR | [ ] | [ ] | ['Tyrosinase-negative oculocutaneous albinism', 'not provided'] |
| NM_000375.2(UROS): c.-26-177T > C | 397515348 | UROS | [ ] | [ ] | ['Congenital erythropoietic porphyria'] |
| NM_015102.4(NPHP4): c.2972T > C (p.Phe991Ser) | 28940891 | NPHP4 | [ ] | [ ] | ['Nephronophthisis 4'] |
| NM_020822.2(KCNT1): c.2386T > C (p.Tyr796His) | 397515406 | KCNT1 | [ ] | [ ] | ['Epilepsy, nocturnal frontal lobe, 5'] |
| NM_000061.2(BTK): c.1516T > C (p.Cys506Arg) | 128621200 | BTK | [ ] | [ ] | ['X-linked agammaglobulinemia'] |
| NM_006383.3(CIB2): c.272T > C (p.Phe91Ser) | 397515411 | CIB2 | [ ] | [ ] | ['Deafness, autosomal recessive 48'] |
| NM_000061.2(BTK): c.1741T > C (p.Trp581Arg) | 128621205 | BTK | ['ACATT YGGGC TTTTG GTAAG TGG'] | ['ACATTYGGGCTT TTGGTAAGTGG'] | ['X-linked agammaglobulinemia'] |
| NM_018127.6(ELAC2): c.460T > C (p.Phe154Leu) | 397515465 | ELAC2 | [ ] | ['ATAYTTTCTGGT CCATTGAAAGG'] | ['Combined oxidative phosphorylation deficiency 17'] |
| NM_199355.2(ADAMTS18): c.605T > C (p.Leu202Pro) | 397515468 | ADAMTS18 | [ ] | [ ] | ['Microcornea, myopic chorioretinal atrophy, and telecanthus'] |
| NM_023110.2(FGFR1): c.494T > C (p.Leu165Ser) | 397515481 | FGFR1 | [ ] | [ ] | ['Hartsfield syndrome'] |
| NM_001059.2(TACR3): | 397515483 | TACR3 | [ ] | [ ] | ['Hypogonadotropic |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.766T > C (p.Tyr256His) | | | | | hypogonadism 11 with or without anosmia'] |
| m.14325T > C | 397515505 | MT-ND6 | [ ] | [ ] | ['Leber optic atrophy'] |
| NM_004333.4(BRAF): c.1783T > C (p.Phe595Leu) | 794729219 | BRAF | [ ] | [ ] | ['Cardiofaciocutaneous syndrome'] |
| NM_000370.3(TTPA): c.548T > C (p.Leu183Pro) | 397515525 | TTPA | [ ] | [ ] | ['Ataxia with vitamin E deficiency'] |
| NM_000375.2(UROS): c.139T > C (p.Ser47Pro) | 397515527 | UROS | [ ] | [ ] | ['Congenital erythropoietic porphyria'] |
| NM_001006657.1(WDR35): c.1592T > C (p.Leu531Pro) | 397515533 | WDR35 | [ ] | [ ] | ['Cranioectodermal dysplasia 2'] |
| NM_004595.4(SMS): c.449T > C (p.Ile150Thr) | 397515552 | SMS | [ ] | [ ] | ['Snyder Robinson syndrome'] |
| NM_005211.3(CSF1R): c.2483T > C (p.Phe828Ser) | 397515557 | CSF1R | [ ] | ['CATCTYTGACTG TGTCTACACGG'] | ['Hereditary diffuse leukoencephalopathy with spheroids'] |
| NM_000026.2(ADSL): c.1339T > C (p.Ser447Pro) | 777821034 | ADSL | [ ] | [ ] | ['not provided'] |
| NM_194248.2(OTOF): c.3413T > C (p.Leu1138Pro) | 397515599 | OTOF | [ ] | ['AGGTGCYGTTCT GGGGCCTACGG', 'GGTGCYGTTCTG GGGCCTACGGG'] | ['Deafness, autosomal recessive 9'] |
| NM_002608.2(PDGFB): c.356T > C (p.Leu119Pro) | 397515632 | PDGFB | [ ] | [ ] | ['Idiopathic basal ganglia calcification 5'] |
| NM_000404.2(GLB1): c.152T > C (p.Ile51Thr) | 72555390 | GLB1 | [ ] | [ ] | ['Gangliosidosis GM1 type 3'] |
| NM_000116.4(TAZ): c.310T > C (p.Phe104Leu) | 397515741 | TAZ | [ ] | [ ] | ['3-Methylglutaconic aciduria type 2'] |
| NM_000138.4(FBN1): c.2341T > C (p.Cys781Arg) | 397515766 | FBN1 | [ ] | ['GGACAAYGTAG AAATACTCCTGG'] | ['Marfan syndrome'] |
| NM_000138.4(FBN1): c.4222T > C (p.Cys1408Arg) | 397515802 | FBN1 | [ ] | [ ] | ['Marfan syndrome'] |
| NM_000112.3(SLC26A2): c.-26 + 2T > C | 386833492 | SLC26A2 | ['GAGA GGYGA GAAGA GGGAA GCGG'] | ['GAGAGGYGAGA AGAGGGAAGCGG'] | ['Diastrophic dysplasia'] |
| NM_000256.3(MYBPC3): c.1351 + 2T > C | 397515897 | MYBPC3 | ['AAAG GYGGG CCTGG GACCT GAGG'] | ['AAAGGYGGGCC TGGGACCTGAGG'] | ['Familial hypertrophic cardiomyopathy 4', 'Cardiomyopathy'] |
| NM_000045.3(ARG1): c.32T > C (p.Ile11Thr) | 28941474 | ARG1 | [ ] | [ ] | ['Arginase deficiency'] |
| NM_004820.3(CYP7B1): c.889A > G (p.Thr297Ala) | 587777222 | CYP7B1 | [ ] | [ ] | ['Spastic paraplegia', 'Spastic paraplegia 5A'] |
| NM_017909.3(RMND1): c.713A > G (p.Asn238Ser) | 144972972 | RMND1 | [ ] | [ ] | ['Combined oxidative phosphorylation deficiency 11'] |
| NM_000314.6(PTEN): c.545T > C (p.Leu182Ser) | 794729664 | PTEN | [ ] | [ ] | ['Macrocephaly/autism syndrome'] |
| NM_000256.3(MYBPC3): c.821 + 2T > C | 397516076 | MYBPC3 | ['CACG YGAGT GGCCA TCCTC AGGG'] | ['GCACGYGAGTG GCCATCCTCAGG', 'CACGYGAGTGGC CATCCTCAGGG'] | ['Familial hypertrophic cardiomyopathy 4', 'not specified'] |
| NM_000257.3(MYH7): c.1370T > C (p.Ile457Thr) | 397516103 | MYH7 | [ ] | [ ] | [Cardiomyopathy', 'not specified'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000257.3(MYH7): c.2093T > C (p.Val698Ala) | 397516130 | MYH7 | [ ] | [ ] | ['Familial hypertrophic cardiomyopathy 1', 'not specified'] |
| NM_000257.3(MYH7): c.2546T > C (p.Met849Thr) | 397516156 | MYH7 | ['GGAGAYGGCCTCCATGAAGGAGG'] | ['GGAGAYGGCCTCCATGAAGGAGG'] | ['Primary familial hypertrophic cardiomyopathy', 'Cardiomyopathy'] |
| NM_000271.4(NPC1): c.1133T > C (p.Val378Ala) | 120074134 | NPC1 | [ ] | [ ] | ['Niemann-Pick disease type C1'] |
| NM_000520.4(HEXA): c.538T > C (p.Tyr180His) | 28941771 | HEXA | [ ] | [ ] | [ ] |
| NM_024426.4(WT1): c.1351T > C (p.Phe451Leu) | 28941777 | WT1 | [ ] | [ ] | ['Diffuse mesangial sclerosis'] |
| NM_024426.4(WT1): c.1378T > C (p.Phe460Leu) | 28941779 | WT1 | [ ] | [ ] | ['Frasier syndrome'] |
| NM_000257.3(MYH7): c.602T > C (p.Ile201Thr) | 397516258 | MYH7 | [ ] | [ ] | ['Dilated cardiomyopathy 1S', 'Cardiomyopathy'] |
| NM_000257.3(MYH7): c.788T > C (p.Ile263Thr) | 397516269 | MYH7 | [ ] | [ ] | ['Primary familial hypertrophic cardiomyopathy', 'Familial hypertrophic cardiomyopathy 1', 'Cardiomyopathy'] |
| NM_001429.3(EP300): c.3573T > A (p.Tyr1191Ter) | 565779970 | EP300 | [ ] | ['CTTAYTACAGTTACCAGAACAGG'] | ['Rubinstein-Taybi syndrome 2'] |
| NM_080605.3(B3GALT6): c.1A > G (p.Met1Val) | 786200938 | B3GALT6 | [ ] | [AGCTTCAYGGCGCCCGCGCCGGG', 'TCAYGGCGCCCGCGCCGGGCCGG'] | ['Spondyloepimetaphyseal dysplasia with joint laxity'] |
| NM_032551.4(KISS1R): c.937T > C (p.Tyr313His) | 587777844 | KISS1R | [ ] | [ ] | [ ] |
| NM_000257.3(MYH7): c.5326A > G (p.Ser1776Gly) | 369437262 | MYH7 | [ ] | [ ] | ['Familial hypertrophic cardiomyopathy 1', 'Cardiomyopathy', 'not specified'] |
| NM_000441.1(SLC26A4): c.164 + 2T > C | 397516420 | SLC26A4 | [ ] | [ ] | ['Pendred syndrome', 'Enlarged vestibular aqueduct syndrome'] |
| NM_000441.1(SLC26A4): c.765 + 2T > C | 397516432 | SLC26A4 | [ ] | [ ] | ['Pendred syndrome', 'Enlarged vestibular aqueduct syndrome'] |
| NM_000551.3(VHL): c.497T > C (p.Val166Ala) | 397516445 | VHL | [ ] | [ ] | ['Von Hippel-Lindau syndrome', 'Hereditary cancer-predisposing syndrome'] |
| NM_000256.3(MYBPC3): c.709T > C (p.Tyr237His) | 730880624 | MYBPC3 | [ ] | [ ] | ['Cardiomyopathy'] |
| NM_000531.5(OTC): c.392T > C (p.Leu131Ser) | 72556252 | OTC | [ ] | [ ] | ['not provided'] |
| NM_000531.5(OTC): c.394T > C (p.Ser132Pro) | 72556253 | OTC | [ ] | [ ] | ['not provided'] |
| NM_000531.5(OTC): c.416T > C (p.Leu139Ser) | 72556259 | OTC | [ ] | [ ] | ['not provided'] |
| NM_000531.5(OTC): c.476T > C (p.Ile159Thr) | 72556269 | OTC | [ ] | [ ] | ['not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000531.5(OTC): c.490T > C (p.Ser164Pro) | 72556273 | OTC | [ ] | [ ] | ['not provided'] |
| NM_000531.5(OTC): c.526T > C (p.Tyr176His) | 72556282 | OTC | ['GGCTGATYACCTCACGCTCCAGG'] | ['GGCTGATYACCTCACGCTCCAGG', 'GATYACCTCACGCTCCAGGTTGG'] | ['not provided'] |
| NM_000531.5(OTC): c.536T > C (p.Leu179Pro) | 72556286 | OTC | [ ] | [ ] | ['not provided'] |
| NM_000229.1(LCAT): c.698T > C (p.Leu233Pro) | 28942087 | LCAT | [ ] | ['ATCTCTCYTGGGGCTCCCTGGGG', 'TCTCYTGGGGCTCCCTGGGGTGG'] | ['Norum disease'] |
| NM_174936.3(PCSK9): c.646T > C (p.Phe216Leu) | 28942112 | PCSK9 | [ ] | [ ] | ['Hypercholesterolemia, autosomal dominant, 3'] |
| NM_004572.3(PKP2): c.2386T > C (p.Cys796Arg) | 794729098 | PKP2 | [ ] | [ ] | ['not provided'] |
| NM_000061.2(BTK): c.1223T > C (p.Leu408Pro) | 128621198 | BTK | ['AGCYGGGGACTGGACAATTTGGG'] | ['GAGCYGGGGACTGGACAATTTGG', 'AGCYGGGGACTGGACAATTTGGG'] | ['X-linked agammaglobulinemia'] |
| NM_000061.2(BTK): c.1625T > C (p.Leu542Pro) | 128621203 | BTK | [ ] | [ICGGCCYGTCCAGGTGAGTGTGG'] | ['X-linked agammaglobulinemia with growth hormone deficiency'] |
| NM_006383.3(CIB2): c.368T > C (p.Ile123Thr) | 397515412 | CIB2 | [ ] | ['CTTCAYCTGCAAGGAGGACCTGG'] | ['Deafness, autosomal recessive 48'] |
| NM_001943.3(DSG2): c.523 + 2T > C | 397516709 | DSG2 | [ ] | [ ] | ['Arrhythmogenic right ventricular cardiomyopathy, type 10', 'Cardiomyopathy'] |
| NM_032575.2(GLIS2): c.523T > C (p.Cys175Arg) | 587777353 | GLIS2 | [ ] | [ ] | ['Nephronophthisis 7'] |
| NM_000492.3(CFTR): c.3230T > C (p.Leu1077Pro) | 139304906 | CFTR | [ ] | [ ] | ['Cystic fibrosis'] |
| NM_000492.3(CFTR): c.1853T > C (p.Ile618Thr) | 139468767 | CFTR | [ ] | [ ] | ['Cystic fibrosis', 'not provided'] |
| NM_002755.3(MAP2K1): c.388T > C (p.Tyr130His) | 397516793 | MAP2K1 | [ ] | [ ] | ['Cardiofaciocutaneous syndrome 3'] |
| NM_000525.3(KCNJ11): c.755T > C (p.Val252Ala) | 193929352 | KCNJ11 | [ ] | [ ] | ['Permanent neonatal diabetes mellitus'] |
| NM_000352.4(ABCC8): c.404T > C (p.Leu135Pro) | 193929364 | ABCC8 | [ ] | ['AAGCYGCTAATTGGTAGGTGAGG'] | ['Permanent neonatal diabetes mellitus'] |
| NM_000071.2(CBS): c.833T > C (p.Ile278Thr) | 5742905 | CBS | ['ATCAYTGGGGTGGATCCCGAAGG', 'TCAYTGGGGTGGATCCCGAAGGG'] | ['ATCAYTGGGGTGGATCCCGAAGG', 'TCAYTGGGGTGGATCCCGAAGGG'] | ['Homocystinuria due to CBS deficiency', 'Homocystinuria, pyridoxine-responsive', 'not provided'] |
| NM_001038.5(SCNN1A): c.1477T > C (p.Trp493Arg) | 5742912 | SCNN1A | [ ] | [ ] | ['Bronchiectasis with or without elevated sweat chloride 2', 'not specified'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000030.2(AGXT): c.2T > C (p.Met1Thr) | 138584408 | AGXT | [ ] | [ ] | ['Primary hyperoxaluria, type I'] |
| NM_005633.3(SOS1): c.1649T > C (p.Leu550Pro) | 397517153 | SOS1 | [ ] | [ ] | ['Noonan syndrome 4', 'Rasopathy'] |
| NM_014714.3(IFT140): c.4078T > C (p.Cys1360Arg) | 431905520 | IFT140 | ['GCAG YGTGA GCTGC TCCTG GAGG'] | [CAAGCAGYGTG AGCTGCTCCTGG', 'GCAGYGTGAGCT GCTCCTGGAGG'] | ['Renal dysplasia, retinal pigmentary dystrophy, cerebellar ataxia and skeletal dysplasia'] |
| NM_022168.3(IFIH1): c.1009A > G (p.Arg337Gly) | 587777447 | IFIH1 | [ ] | [ ] | ['Aicardi-goutieres syndrome 7'] |
| NG_012123.1:g.2493 A > G | 1024611 | CCL2 | [ ] | [ ] | ['Coronary artery disease, modifier of', 'Coronary artery disease, development of, in hiv', 'Mycobacterium tuberculosis, susceptibility to'] |
| m.3394T > C | 41460449 | MT-ND1 | ['GGCY ATATA CAACT ACGCA AAGG'] | ['GGCYATATACA ACTACGCAAAGG'] | ['Leber optic atrophy'] |
| NM_001127328.2(ACADM): c.997A > G (p.Lys333Glu) | 77931234 | ACADM | [ ] | [ ] | ['Medium-chain acyl-coenzyme A dehydrogenase deficiency', 'not provided'] |
| NM_005859.4(PURA): c.299T > C (p.Leu100Pro) | 587782995 | PURA | [ ] | [ ] | ['Neonatal hypotonia', 'Intellectual disability', 'Seizures', 'Delayed speech and language development', 'Global developmental delay', 'Mental retardation, autosomal dominant 31'] |
| NM_000368.4(TSC1): c.539T > C (p.Leu180Pro) | 118203396 | TSC1 | [ ] | [ ] | ['Tuberous sclerosis syndrome', 'Tuberous sclerosis 1'] |
| NM_000256.3(MYBPC3): c.1696T > C (p.Cys566Arg) | 730880695 | MYBPC3 | [ ] | [ ] | ['Cardiomyopathy'] |
| m.7275T > C | 267606884 | MT-CO1 | [ ] | [ ] | ['Familial colorectal cancer'] |
| NM_000257.3(MYH7): c.1400T > C (p.Ile467Thr) | 730880872 | MYH7 | [ ] | ['TCGAGAYCTTCG ATGTGAGTTGG', 'CGAGAYCTTCGA TGTGAGTTGGG'] | ['Cardiomyopathy'] |
| NM_002977.3(SCN9A): c.647T > C (p.Phe216Ser) | 80356469 | SCN9A | [ ] | [ ] | ['Primary erythromelalgia'] |
| NM_002977.3(SCN9A): c.2543T > C (p.Ile848Thr) | 80356474 | — | [ ] | ['AAGATCAYTGGT AACTCAGTAGG', 'AGATCAYTGGTA ACTCAGTAGGG', 'GATCAYTGGTAA CTCAGTAGGGG'] | ['Primary erythromelalgia'] |
| NM_001164277.1(SLC37A4): c.352T > C (p.Trp118Arg) | 80356489 | SLC37A4 | [ ] | ['GGGCYGGCCCC CATGTGGGAAGG'] | ['Glucose-6-phosphate transport defect', 'not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001457.3(FLNB):<br>c.4804T > C<br>(p.Ser1602Pro) | 80356501 | FLNB | [ ] | [ ] | [ ] |
| NM_152296.4(ATP1A3):<br>c.2338T > C<br>(p.Phe780Leu) | 80356536 | ATP1A3 | [ ] | ['GCCCYTCCTGCT<br>GTTCATCATGG'] | ['Dystonia 12'] |
| NM_206933.2(USH2A):<br>c.5857 + 2T > C | 397518022 | — | [ ] | [ ] | ['Usher syndrome,<br>type 2A'] |
| NM_194248.2(OTOF):<br>c.1544T > C<br>(p.Ile515Thr) | 80356586 | OTOF | [ ] | [ ] | ['Deafness,<br>autosomal recessive<br>9', 'Auditory<br>neuropathy,<br>autosomal recessive,<br>1'] |
| NM_000335.4(SCN5A):<br>c.3745T > C<br>(p.Phe1249Leu) | 45589741 | SCN5A | [ ] | [ ] | ['Acquired long QT<br>syndrome'] |
| NM_194248.2(OTOF):<br>c.3032T > C<br>(p.Leu1011Pro) | 80356596 | OTOF | [ ] | [GATGCYGGTGTT<br>CGACAACCTGG] | ['Deafness,<br>autosomal recessive<br>9', 'Auditory<br>neuropathy,<br>autosomal recessive,<br>1'] |
| NM_000525.3(KCNJ11):<br>c.124T > C<br>(p.Cys42Arg) | 80356610 | KCNJ11 | [ ] | [ ] | ['Permanent neonatal<br>diabetes mellitus',<br>'Transient neonatal<br>diabetes mellitus 3',<br>'MATURITY-<br>ONSET DIABETES<br>OF THE YOUNG,<br>TYPE 13'] |
| NM_000257.3(MYH7):<br>c.2723T > C<br>(p.Leu908Pro) | 730880900 | MYH7 | [ ] | [ ] | ['Cardiomyopathy'] |
| NM_152296.4(ATP1A3):<br>c.1112T > C<br>(p.Leu371Pro) | 606231433 | ATP1A3 | [ ] | [ ] | ['Alternating<br>hemiplegia of<br>childhood 2'] |
| NM_000083.2(CLCN1):<br>c.857T > C<br>(p.Val286Ala) | 80356689 | CLCN1 | [ ] | [AGGAGYGCTATT<br>TAGCATCGAGG] | ['Myotonia<br>congenita'] |
| NM_000083.2(CLCN1):<br>c.920T > C<br>(p.Phe307Ser) | 80356701 | CLCN1 | [ ] | [ ] | ['Myotonia<br>congenita'] |
| NM_007375.3(TARDBP):<br>c.*83T > C | 80356744 | TARDBP | [ ] | [ ] | ['Amyotrophic<br>lateral sclerosis type<br>10'] |
| NM_152296.4(ATP1A3):<br>c.1250T > C<br>(p.Leu417Pro) | 606231449 | ATP1A3 | [ ] | [ ] | ['Dystonia 12'] |
| NM_001876.3(CPT1A):<br>c.1451T > C<br>(p.Leu484Pro) | 80356793 | CPT1A | [ ] | [ ] | [Carnitine<br>palmitoyltransferase<br>I deficiency'] |
| NM_000088.3(COL1A1):<br>c.4391T > C<br>(p.Leu1464Pro) | 72656353 | COL1A1 | [ ] | [ ] | ['Osteogenesis<br>imperfecta type III'] |
| NM_000089.3(COL1A2):<br>c.279 + 2T > C | 72656357 | COL1A2 | [ ] | [ ] | ['Ehlers-Danlos<br>syndrome, type 7B'] |
| NM_015046.5(SETX):<br>c.1807A > G<br>(p.Asn603Asp) | 116205032 | SETX | [ ] | [ ] | ['Spinocerebellar<br>ataxia autosomal<br>recessive 1'] |
| m.4409T > C | 118203884 | MT-TM | [ ] | ['AGGYCAGCTAA<br>ATAAGCTATCGG'] | ['Mitochondrial<br>myopathy'] |
| m.5874T > C | 118203891 | MT-TY | [ ] | [ ] | [ ] |
| NM_000130.4(F5):<br>c.1160T > C (p.Ile387Thr) | 118203911 | F5 | [ ] | [ ] | ['Thrombophilia due<br>to activated protein<br>C resistance'] |
| NM_173596.2(SLC39A5):<br>c.911T > C<br>(p.Met304Thr) | 587777625 | SLC39A5 | [ ] | ['AGAACAYGCTG<br>GGGCTTTTGCGG'] | ['Myopia 24,<br>autosomal<br>dominant'] |
| NM_024120.4(NDUFAF5):<br>c.686T > C<br>(p.Leu229Pro) | 118203929 | NDUFAF5 | [ ] | [ ] | ['Mitochondrial<br>complex I<br>deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_003159.2(CDKL5): c.602T > C (p.Leu201Pro) | 587783087 | CDKL5 | [ ] | ['ATTCYTGGGGAG CTTAGCGATGG'] | ['not provided'] |
| NM_000046.3(ARSB): c.349T > C (p.Cys117Arg) | 118203939 | ARSB | [ ] | [ ] | ['MUCOPOLYSAC CHARIDOSIS, TYPE VI, SEVERE'] |
| NM_000046.3(ARSB): c.707T > C (p.Leu236Pro) | 118203940 | ARSB | [ ] | [ ] | ['MUCOPOLYSAC CHARIDOSIS, TYPE VI, MILD'] |
| NM_013319.2(UBIAD1): c.511T > C (p.Ser171Pro) | 118203951 | UBIAD1 | [ ] | ['TCTGGCYCCTTT CTCTACACAGG', 'GGCYCCTTTCTCT ACACAGGAGG'] | ['Schnyder crystalline corneal dystrophy'] |
| NM_138387.3(G6PC3): c.554T > C (p.Leu185Pro) | 118203969 | G6PC3 | [ ] | [ ] | ['Severe congenital neutropenia 4, autosomal recessive'] |
| NM_006364.2(SEC23A): c.1144T > C (p.Phe382Leu) | 118204000 | SEC23A | [ ] | [ ] | ['Craniolenticulosutural dysplasia'] |
| NM_000429.2(MAT1A): c.914T > C (p.Leu305Pro) | 118204004 | MAT1A | [ ] | [ ] | ['Methionine adenosyltransferase deficiency, autosomal recessive'] |
| NM_000018.3(ACADVL): c.1372T > C (p.Phe458Leu) | 118204017 | ACADVL | [ ] | ['TCGCATCYTCCG GATCTTTGAGG', 'CGCATCYTCCGG ATCTTTGAGGG', 'GCATCYTCCGGA TCTTTGAGGGG'] | ['Very long chain acyl-CoA dehydrogenase deficiency'] |
| NM_000833.4(GRIN2A): c.2T > C (p.Met1Thr) | 397518466 | GRIN2A | [ ] | ['CTAYGGGCAGA GTGGGCTATTGG'] | ['Focal epilepsy with speech disorder with or without mental retardation'] |
| NM_015702.2(MMADHC): c.776T > C (p.Leu259Pro) | 118204044 | MMADHC | [ ] | [ ] | ['Homocystinuria, cblD type, variant 1'] |
| NM_018077.2(RBM28): c.1052T > C (p.Leu351Pro) | 118204055 | RBM28 | [ ] | [ ] | ['Alopecia, neurologic defects, and endocrinopathy syndrome'] |
| NM_000237.2(LPL): c.662T > C (p.Ile221Thr) | 118204061 | LPL | [ ] | [ ] | ['Hyperlipoproteinemia, type I'] |
| NM_000237.2(LPL): c.337T > C (p.Trp113Arg) | 118204069 | LPL | [ ] | ['GGACYGGCTGTC ACGGGCTCAGG'] | ['Hyperlipoproteinemia, type I'] |
| NM_000237.2(LPL): c.755T > C (p.Ile252Thr) | 118204080 | LPL | [ ] | ['GTGAYTGCAGA GAGAGGACTTGG'] | ['Hyperlipoproteinemia, type I'] |
| NM_000155.3(GALT): c.580T > C (p.Phe194Leu) | 111033726 | GALT | [ ] | [ ] | ['Deficiency of UDPglucose-hexose-1-phosphate uridylyltransferase'] |
| NM_000190.3(HMBS): c.739T > C (p.Cys247Arg) | 118204111 | HMBS | [ ] | ['GCTTCGCYGCAT CGCTGAAAGGG'] | ['Acute intermittent porphyria'] |
| NM_000190.3(HMBS): c.242T > C (p.Leu81Pro) | 118204119 | HMBS | [ ] | [ ] | ['Acute intermittent porphyria'] |
| NM_001363.4(DKC1): c.1193T > C (p.Leu398Pro) | 199422253 | DKC1 | [ ] | [ ] | ['Dyskeratosis congenita X-linked'] |
| NM_004278.3(PIGL): c.500T > C (p.Leu167Pro) | 145303331 | PIGL | [ ] | [ ] | ['Zunich neuroectodermal syndrome'] |
| NM_000531.5(OTC): c.602T > C (p.Leu201Pro) | 72558407 | OTC | [ ] | [ ] | ['not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000531.5(OTC): c.779T > C (p.Leu260Ser) | 72558441 | OTC | ['ATGTATYAATTACAGACACTTGG'] | ['ATGTATYAATTACAGACACTTGG'] | ['not provided'] |
| NM_000531.5(OTC): c.803T > C (p.Met268Thr) | 72558449 | OTC | [ ] | [ ] | ['not provided'] |
| NM_000256.3(MYBPC3): c.1814A > G (p.Asp605Gly) | 372371774 | MYBPC3 | [ ] | [ ] | ['Primary dilated cardiomyopathy', 'Cardiomyopathy', 'not specified'] |
| NM_000531.5(OTC): c.947T > C (p.Phe316Ser) | 72558471 | OTC | [ ] | [ ] | ['not provided'] |
| NM_000531.5(OTC): c.1005 + 2T > C | 72558484 | OTC | ['ATCATGGYAAGCAAGAAACAAGG'] | ['ATCATGGYAAGCAAGAAACAAGG'] | ['not provided'] |
| NM_000531.5(OTC): c.1018T > C (p.Ser340Pro) | 72558489 | OTC | [ ] | [ ] | ['not provided'] |
| NM_000531.5(OTC): c.1022T > C (p.Leu341Pro) | 72558490 | OTC | [ ] | [ ] | ['not provided'] |
| NM_007294.3(BRCA1): c.5291T > C (p.Leu1764Pro) | 80357281 | BRCA1 | ['GGCYAGAAATCTGTTGCTATGGG'] | ['GGGCYAGAAATCTGTTGCTATGG', 'GGCYAGAAATCTGTTGCTATGGG'] | ['Familial cancer of breast', 'Breast-ovarian cancer, familial 1'] |
| NM_000035.3(ALDOB): c.442T > C (p.Trp148Arg) | 118204430 | ALDOB | ['GGAAGYGGCGTGCTGTGCTGAGG'] | ['GGAAGYGGCGTGCTGTGCTGAGG'] | ['Hereditary fructosuria'] |
| NM_000512.4(GALNS): c.413T > C (p.Val138Ala) | 118204436 | GALNS | [ ] | [ ] | ['Mucopolysaccharidosis, MPS-IV-A'] |
| NM_024782.2(NHEJ1): c.367T > C (p.Cys123Arg) | 118204452 | NHEJ1 | [ ] | [ ] | ['Severe combined immunodeficiency with microcephaly, growth retardation, and sensitivity to ionizing radiation'] |
| NM_007294.3(BRCA1): c.65T > C (p.Leu22Ser) | 80357438 | BRCA1 | [ ] | ['AAATCTYAGAGTGTCCCATCTGG'] | ['Familial cancer of breast', 'Breast-ovarian cancer, familial 1', 'Hereditary cancer-predisposing syndrome'] |
| m.12297T > C | 121434464 | MT-TL2 | ['GTCYTAGGCCCCAAAAATTTTGG'] | ['GTCYTAGGCCCCAAAAATTTTGG'] | ['Cardiomyopathy, mitochondrial'] |
| NM_001040431.2(COA3): c.215A > G (p.Tyr72Cys) | 139877390 | COA3 | [ ] | ['CCAYCTGGGGAGGTAGGTTCAGG'] | [ ] |
| m.10010T > C | 121434476 | MT-TG | [ ] | [ ] | ['Exercise intolerance'] |
| NM_000860.5(HPGD): c.577T > C (p.Ser193Pro) | 121434481 | HPGD | [ ] | [ ] | ['Digital clubbing, isolated congenital'] |
| NM_024915.3(GRHL2): c.1192T > C (p.Tyr398His) | 587777737 | GRHL2 | [ ] | [ ] | ['Ectodermal dysplasia/short stature syndrome'] |
| NM_032374.4(APOPT1): c.353T > C (p.Phe118Ser) | 587777786 | APOPT1 | [ ] | [ ] | ['Cytochrome-c oxidase deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001605.2(AARS): c.2251A > G (p.Arg751Gly) | 143370729 | AARS | [ ] | [ ] | ['EPILEPTIC ENCEPHALOPATHY, EARLY INFANTILE, 29'] |
| NM_000257.3(MYH7): c.2479T > C (p.Trp827Arg) | 730880744 | MYH7 | [ ] | [ ] | ['Cardiomyopathy'] |
| NM_017415.2(KLHL3): c.1160T > C (p.Leu387Pro) | 199469630 | KLHL3 | | | ['Pseudohypoaldosteronism, type 2'] |
| NM_017415.2(KLHL3): c.1280T > C (p.Met427Thr) | 199469642 | KLHL3 | | | ['Pseudohypoaldosteronism, type 2'] |
| NM_005859.4(PURA): c.563T > C (p.Ile188Thr) | 793888527 | PURA | [ ] | ['GACCAYTGCGCT GCCCGCGCAGG', 'ACCAYTGCGCTG CCCGCGCAGGG', 'CCAYTGCGCTGC CCGCGCAGGGG'] | ['not provided', 'Mental retardation, autosomal dominant 31'] |
| NM_007294.3(BRCA1): c.212 + 2T > C | 80358026 | BRCA1 | [ ] | [ ] | ['Familial cancer of breast', 'Breast-ovarian cancer, familial 1'] |
| NM_002878.3(RAD51D): c.1A > G (p.Met1Val) | 561425038 | — | [ ] | ['CGCCCAYGTTCC CCGCAGGCCGG'] | ['Hereditary cancer-predisposing syndrome'] |
| NM_018960.4(GNMT): c.149T > C (p.Leu50Pro) | 121907888 | GNMT | [ ] | [ ] | ['Glycine N-methyltransferase deficiency'] |
| NM_007294.3(BRCA1): c.5074 + 2T > C | 80358089 | BRCA1 | [ ] | [ ] | ['Breast-ovarian cancer, familial 1'] |
| NC_012920.1:m.1198 4T > C | 200911567 | MT-ND4 | [ ] | [ ] | ['Leigh disease'] |
| NM_000280.4(PAX6): c.773T > C (p.Phe258Ser) | 121907925 | PAX6 | [ ] | [ ] | ['Congenital ocular coloboma', 'Coloboma of optic disc'] |
| NM_020117.9(LARS): c.1118A > G (p.Tyr373Cys) | 201861847 | LARS | [ ] | [ ] | ['Infantile liver failure syndrome 1'] |
| NM_024105.3(ALG12): c.473T > C (p.Leu158Pro) | 121907934 | ALG12 | [ ] | ['TCCYGCTGGCCC TCGCGGCCTGG'] | ['Congenital disorder of glycosylation type 1G'] |
| NM_000152.3(GAA): c.953T > C (p.Met318Thr) | 121907936 | GAA | [ ] | [ ] | ['Glycogen storage disease type II, infantile'] |
| NM_000520.4(HEXA): c.1453T > C (p.Trp485Arg) | 121907968 | HEXA | [ ] | [ ] | ['Tay-Sachs disease'] |
| NM_000520.4(HEXA): c.632T > C (p.Phe211Ser) | 121907974 | HEXA | [ ] | [ ] | ['Tay-Sachs disease'] |
| NM_000053.3(ATP7B): c.2123T > C (p.Leu708Pro) | 121908000 | ATP7B | [ ] | [ ] | ['Wilson disease'] |
| NM_000375.2(UROS): c.217T > C (p.Cys73Arg) | 121908012 | UROS | [ ] | [ ] | ['Congenital erythropoietic porphyria'] |
| NM_153212.2(GJB4): c.409T > C (p.Phe137Leu) | 80358207 | GJB4 | [ ] | ['CCTCATCYTCAA GGCCGCCGTGG'] | ['Erythrokeratodermia variabilis'] |
| NM_000403.3(GALE): c.548T > C (p.Leu183Pro) | 121908045 | GALE | [ ] | [ ] | ['UDPglucose-4-epimerase deficiency'] |
| NM_002353.2(TACSTD2): c.557T > C (p.Leu186Pro) | 80358228 | TACSTD2 | [ ] | ['ICGGCYGCACCC CAAGTTCGTGG'] | ['Lattice corneal dystrophy Type III'] |
| NM_001563.3(IMPG1): c.461T > C (p.Leu154Pro) | 713993047 | IMPG1 | [ ] | [ ] | ['Macular dystrophy, vitelliform, 4'] |
| NM_138691.2(TMC1): c.1543T > C (p.Cys515Arg) | 121908076 | TMC1 | [ ] | ['AGGACCTYGCTG GGAAACAATGG', 'ACCTYGCTGGGA'] | ['Deafness, autosomal recessive 7'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | | AACAATGGTGG', 'CCTYGCTGGGAA ACAATGGTGGG'] | |
| NM_000271.4(NPC1): c.3182T > C (p.Ile1061Thr) | 80358259 | NPC1 | [ ] | [ ] | ['Niemann-Pick disease type C1'] |
| NM_006432.3(NPC2): c.295T > C (p.Cys99Arg) | 80358264 | NPC2 | [ ] | [ ] | ['Niemann-Pick disease type C2'] |
| NM_017838.3(NHP2): c.415T > C (p.Tyr139His) | 121908089 | NHP2 | [ ] | ['GGAGGCTYACG ATGAGTGCCTGG', 'GGCTYACGATGA GTGCCTGGAGG'] | ['Dyskeratosis congenita autosomal recessive 1', 'Dyskeratosis congenita, autosomal recessive 2'] |
| NM_005857.4(ZMPSTE24): c.1018T > C (p.Trp340Arg) | 121908093 | ZMPSTE24 | [ ] | [ ] | ['Mandibuloacral dysplasia with type B lipodystrophy', 'not provided'] |
| NM_001195794.1(CLRN1): c.488T > C (p.Leu163Pro) | 121908142 | CLRN1 | [ ] | [ ] | ['Usher syndrome, type 3'] |
| NM_057176.2(BSND): c.35T > C (p.Ile12Thr) | 121908144 | BSND | [ ] | [ ] | ['Sensorineural deafness with mild renal dysfunction'] |
| NM_001243133.1(NLRP3): c.1718T > C (p.Phe573Ser) | 121908152 | NLRP3 | [ ] | [ ] | ['Familial cold urticaria', 'Chronic infantile neurological, cutaneous and articular syndrome'] |
| NM_001243133.1(NLRP3): c.926T > C (p.Phe309Ser) | 121908154 | NLRP3 | [ ] | ['GGTGCCTYTGAC GAGCACATAGG'] | ['Familial cold urticaria', 'Chronic infantile neurological, cutaneous and articular syndrome'] |
| NM_153741.1(DPM3): c.254T > C (p.Leu85Ser) | 121908155 | DPM3 | [ ] | [ ] | ['Congenital disorder of glycosylation type 1O'] |
| NM_001033855.2(DCLRE1C): c.2T > C (p.Met1Thr) | 121908158 | DCLRE1C | [ ] | ['GGCGCTAYGAG TTCTTTCGAGGG', 'GCGCTAYGAGTT CTTTCGAGGGG'] | ['Histiocytic medullary reticulosis'] |
| NM_017696.2(MCM9): c.1732 + 2T > C | 587777871 | MCM9 | [ ] | [ ] | ['Premature ovarian failure 1', 'Ovarian dysgenesis 4'] |
| NM_031433.3(MFRP): c.545T > C (p.Ile182Thr) | 121908190 | — | [ ] | [ ] | ['Nanophthalmos 2'] |
| NM_001127221.1(CACNA1A): c.2141T > C (p.Val714Ala) | 121908213 | CACNA1A | [ ] | [ ] | ['Familial hemiplegic migraine type 1'] |
| NM_001127221.1(CACNA1A): c.4469T > C (p.Phe1490Ser) | 121908233 | CACNA1A | [ ] | [ ] | ['Episodic ataxia type 2'] |
| NM_133459.3(CCBE1): c.520T > C (p.Cys174Arg) | 121908254 | CCBE1 | [ ] | [ ] | ['Hennekam lymphangiectasia-lymphedema syndrome'] |
| NM_018129.3(PNPO): c.2T > C (p.Met1Thr) | 796052870 | PNPO | [ ] | ['CCCCCAYGACGT GCTGGCTGCGG', 'CCCCAYGACGTG CTGGCTGCGGG', 'CCCAYGACGTGC TGGCTGCGGGG'] | ['not provided'] |
| NM_014845.5(FIG4): c.122T > C (p.Ile41Thr) | 121908287 | FIG4 | [ ] | [ ] | ['Charcot-Marie-Tooth disease, type 4J', 'not provided'] |
| NM_001005741.2(GBA): c.751T > C (p.Tyr251His) | 121908300 | GBA | ['GCCA GAYAC TTTGT | ['GCCAGAYACTTT GTGAAGTAAGG', 'CCAGAYACTTTG | ['Gaucher disease, type 1'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | GAAGTAAGG'] | TGAAGTAAGGG'] | |
| NM_020427.2(SLURP1): c.43T > C (p.Trp15Arg) | 121908318 | SLURP1 | [ ] | ['GCAGCCYGGAG CATGGGCTGTGG'] | ['Acroerythro- keratoderma'] |
| NM_020427.2(SLURP1): c.229T > C (p.Cys77Arg) | 121908319 | SLURP1 | [ ] | [ ] | ['Acroerythro- keratoderma'] |
| NM_000787.3(DBH): c.339 + 2T > C | 74853476 | DBH | [ ] | [ ] | ['Dopamine beta hydroxylase deficiency'] |
| NM_017882.2(CLN6): c.200T > C (p.Leu67Pro) | 154774633 | CLN6 | ['AGCYGGTATTCCCTCTCGAGTGG'] | ['AGCYGGTATTCC CTCTCGAGTGG'] | ['Adult neuronal ceroid lipofuscinosis', 'not provided'] |
| NM_022124.5(CDH23): c.5663T > C (p.Phe1888Ser) | 121908352 | CDH23 | [ ] | ['CTCACCTYCAAC ATCACTGCGGG'] | ['Deafness, autosomal recessive 12'] |
| NM_054027.4(ANKH): c.143T > C (p.Met48Thr) | 121908407 | ANKH | ['GTCGAGAYGCTGGCCAGCTACGG', 'TCGAGAYGCTGGCCAGCTACGGG'] | ['GTCGAGAYGCT GGCCAGCTACGG', 'TCGAGAYGCTGG CCAGCTACGGG'] | ['Chondrocalcinosis 2'] |
| NM_004924.4(ACTN4): c.784T > C (p.Ser262Pro) | 121908417 | ACTN4 | [ ] | [ ] | ['Focal segmental glomerulosclerosis 1'] |
| NM_014384.2(ACAD8): c.455T > C (p.Met152Thr) | 121908418 | ACAD8 | [ ] | [ ] | ['Deficiency of isobutyryl-CoA dehydrogenase'] |
| NM_153717.2(EVC): c.919T > C (p.Ser307Pro) | 121908426 | EVC | [ ] | [ ] | ['Chondroectodermal dysplasia', 'Curry-Hall syndrome'] |
| NM_001040108.1(MLH3): c.3826T > C (p.Trp1276Arg) | 121908439 | MLH3 | [ ] | [ ] | ['Hereditary nonpolyposis colorectal cancer type 7'] |
| NM_013339.3(ALG6): c.1432T > C (p.Ser478Pro) | 121908444 | ALG6 | [ ] | [ ] | ['Congenital disorder of glycosylation type 1C'] |
| NM_003835.3(RGS9): c.895T > C (p.Trp299Arg) | 121908449 | RGS9 | [ ] | [ ] | ['Prolonged electroretinal response suppression'] |
| NM_022336.3(EDAR): c.259T > C (p.Cys87Arg) | 121908451 | EDAR | [ ] | [ ] | ['Autosomal recessive hypohidrotic ectodermal dysplasia syndrome'] |
| NM_014270.4(SLC7A9): c.131T > C (p.Ile44Thr) | 121908485 | SLC7A9 | [ ] | [ ] | ['Cystinuria'] |
| NM_000030.2(AGXT): c.613T > C (p.Ser205Pro) | 121908520 | AGXT | [ ] | [CCTGTACYCGGG CTCCCAGAAGG'] | ['Primary hyperoxaluria, type I'] |
| NM_000030.2(AGXT): c.731T > C (p.Ile244Thr) | 121908525 | AGXT | [ ] | [ ] | ['Primary hyperoxaluria, type I'] |
| NM_000026.2(ADSL): c.1312T > C (p.Ser438Pro) | 119450940 | ADSL | [ ] | [ ] | ['Adenylosuccinate lyase deficiency'] |
| NM_000026.2(ADSL): c.674T > C (p.Met225Thr) | 119450945 | ADSL | ['AAGAYGGTGACAGAAAAGGCAGG'] | ['AAGAYGGTGAC AGAAAAGGCAGG'] | ['Adenylosuccinate lyase deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
| --- | --- | --- | --- | --- | --- |
| NM_014985.3(CEP152): c.2000A > G (p.Lys667Arg) | 200879436 | CEP152 | [ ] | [ ] | ['Seckel syndrome 5', 'not specified'] |
| NM_002755.3(MAP2K1): c.158T > C (p.Phe53Ser) | 121908594 | MAP2K1 | [ ] | [ ] | ['Cardiofaciocutaneous syndrome 3', 'Rasopathy'] |
| NM_004820.3(CYP7B1): c.647T > C (p.Phe216Ser) | 121908612 | CYP7B1 | [ ] | [ ] | ['Spastic paraplegia 5A'] |
| NM_004273.4(CHST3): c.776T > C (p.Leu259Pro) | 121908616 | CHST3 | [ ] | [ ] | ['Spondyloepiphyseal dysplasia with congenital joint dislocations'] |
| NM_004273.4(CHST3): c.920T > C (p.Leu307Pro) | 121908618 | CHST3 | [ ] | ['CGTGCYGGCCTC GCGCATGGTGG'] | ['Spondyloepiphyseal dysplasia with congenital joint dislocations'] |
| NM_004273.4(CHST3): c.857T > C (p.Leu286Pro) | 121908620 | CHST3 | [ ] | [ ] | ['Spondyloepiphyseal dysplasia with congenital joint dislocations'] |
| NM_000050.4(ASS1): c.535T > C (p.Trp179Arg) | 121908646 | ASS1 | [ ] | [ ] | [ ] |
| NM_030761.4(WNT4): c.35T > C (p.Leu12Pro) | 121908653 | WNT4 | [ ] | [ ] | ['Mullerian aplasia and hyperandrogenism'] |
| NM_006432.3(NPC2): c.199T > C (p.Ser67Pro) | 11694 | NPC2 | [ ] | ['TATTCAGYCTAA AAGCAGCAAGG'] | ['Niemann-Pick disease type C2'] |
| NM_003839.3(TNFRSF11A): c.523T > C (p.Cys175Arg) | 121908656 | TNFRSF11A | [ ] | [ ] | ['Osteopetrosis autosomal recessive 7'] |
| NM_000022.2(ADA): c.320T > C (p.Leu107Pro) | 121908739 | ADA | [ ] | ['CCTGCYGGCCAA CTCCAAAGTGG'] | ['Severe combined immunodeficiency due to ADA deficiency'] |
| NM_000140.3(FECH): c.315-48T > C | 2272783 | FECH | [ ] | [ ] | ['Erythropoietic protoporphyria'] |
| NM_000059.3(BRCA2): c.7529T > C (p .Leu2510Pro) | 80358979 | BRCA2 | [ ] | [ ] | ['Familial cancer of breast', 'Breast-ovarian cancer, familial 2', 'Fanconi anemia, complementation group D1'] |
| NM_003722.4(TP63): c.1033T > C (p.Cys345Arg) | 121908837 | TP63 | [ ] | [ ] | ['Ectrodactyly, ectodermal dysplasia, and cleft lip/palate syndrome 3'] |
| NM_003722.4(TP63): c.1646T > C (p.Ile549Thr) | 121908845 | TP63 | [ ] | [ ] | ['Hay-Wells syndrome of ectodermal dysplasia', 'Rapp-Hodgkin ectodermal dysplasia syndrome'] |
| NM_000059.3(BRCA2): c.7958T > C (p.Leu2653Pro) | 80359022 | BRCA2 | [ ] | ['TGCYTCTTCAAC TAAAATACAGG'] | ['Familial cancer of breast', 'Breast-ovarian cancer, familial 2'] |
| NM_000369.2(TSHR): c.1891T > C (p.Phe631Leu) | 121908861 | TSHR | [ ] | [ ] | ['Hyperthyroidism, nonautoimmune', 'Thyroid adenoma, hyperfunctioning'] |
| NM_000369.2(TSHR): c.1358T > C (p.Met453Thr) | 121908864 | TSHR | [ ] | [ ] | ['Hyperthyroidism, nonautoimmune'] |
| NM_000369.2(TSHR): c.1526T > C (p.Val509Ala) | 121908874 | TSHR | [ ] | [ ] | ['Hyperthyroidism, nonautoimmune'] |
| NM_000369.2(TSHR): c.1798T > C (p.Cys600Arg) | 121908884 | TSHR | [ ] | [ ] | ['Hypothyroidism, congenital, nongoitrous, 1'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000369.2(TSHR): c.1400T > C (p.Leu467Pro) | 121908885 | TSHR | [ ] | [ ] | ['Hypothyroidism, congenital, nongoitrous, 1'] |
| NM_001457.3(FLNB): c.703T > C (p.Ser235Pro) | 121908896 | FLNB | [ ] | [ ] | ['Boomerang dysplasia'] |
| NM_003880.3(WISP3): c.232T > C (p.Cys78Arg) | 121908902 | WISP3 | [ ] | ['AAAATCYGTGCC AAGCAACCAGG', 'AAATCYGTGCCA AGCAACCAGGG', 'AATCYGTGCCAA GCAACCAGGGG'] | ['Progressive pseudorheumatoid dysplasia'] |
| NM_003880.3(WISP3): c.1000T > C (p.Ser334Pro) | 121908903 | WISP3 | [ ] | [ ] | ['Progressive pseudorheumatoid dysplasia'] |
| NM_002977.3(SCN9A): c.4382T > C (p.Ile1461Thr) | 121908914 | — | [ ] | [ ] | ['Paroxysmal extreme pain disorder'] |
| NM_004086.2(COCH): c.349T > C (p.Trp117Arg) | 121908929 | — | [ ] | [ ] | ['Deafness, autosomal dominant 9'] |
| NM_004086.2(COCH): c.1535T > C (p.Met512Thr) | 121908934 | — | ['AGAT AYGGC TTCTA AACCG AAGG'] | ['AGATAYGGCTTC TAAACCGAAGG'] | ['Deafness, autosomal dominant 9'] |
| NM_006892.3(DNMT3B): c.808T > C (p.Ser270Pro) | 121908947 | DNMT3B | [ ] | ['CAAGTTCYCCGA GGTGAGTCCGG', 'AAGTTCYCCGAG GTGAGTCCGGG', 'AGTTCYCCGAGG TGAGTCCGGGG'] | ['Centromeric instability of chromosomes 1,9 and 16 and immunodeficiency'] |
| NM_000226.3(KRT9): c.503T > C (p.Leu168Ser) | 61157095 | KRT9 | [ ] | [ ] | ['Epidermolytic palmoplantar keratoderma', 'not provided'] |
| NM_000051.3(ATM): c.8584 + 2T > C | 730881326 | — | [ ] | [ ] | ['Hereditary cancer-predisposing syndrome'] |
| NM_000492.3(CFTR): c.3857T > C (p.Phe1286Ser) | 121909028 | CFTR | [ ] | ['AGCCTYTGGAGT GATACCACAGG'] | ['Cystic fibrosis'] |
| NM_000492.3(CFTR): c.3763T > C (p.Ser1255Pro) | 121909041 | CFTR | [ ] | [ ] | ['Cystic fibrosis'] |
| NM_001040667.2(HSF4): c.341T > C (p.Leu114Pro) | 121909048 | HSF4 | [ ] | [ ] | ['Cataract, zonular'] |
| NM_005025.4(SERPINI1): c.145T > C (p.Ser49Pro) | 121909051 | SERPINI1 | [ ] | [ ] | ['Familial encephalopathy with neuroserpin inclusion bodies'] |
| NM_002700.2(POU4F3): c.668T > C (p.Leu223Pro) | 121909057 | POU4F3 | [ ] | [ ] | ['Deafness, autosomal dominant 15'] |
| NM_003322.4(TULP1): c.1471T > C (p.Phe491Leu) | 121909074 | TULP1 | [ ] | [ ] | ['Retinitis pigmentosa 14'] |
| NM_003322.4(TULP1): c.1145T > C (p.Phe382Ser) | 121909076 | TULP1 | [ ] | [ ] | ['Retinitis pigmentosa', 'Retinitis pigmentosa 14'] |
| NM_003000.2(SDHB): c.487T > C (p.Ser163Pro) | 33927012 | SDHB | [ ] | [ ] | ['Pheochromocytoma', 'Hereditary Paraganglioma-Pheochromocytoma Syndromes', 'Hereditary cancer-predisposing syndrome', 'Cowden syndrome 2', 'not specified', 'not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_005603.4(ATP8B1): c.863T > C (p.Leu288Ser) | 121909099 | ATP8B1 | [ ] | [ ] | ['Progressive intrahepatic cholestasis'] |
| NM_005603.4(ATP8B1): c.1982T > C (p.Ile661Thr) | 121909100 | ATP8B1 | [ ] | [ ] | ['Progressive intrahepatic cholestasis', 'Benign recurrent intrahepatic cholestasis 1'] |
| NM_000483.4(APOC2): c.142T > C (p.Trp48Arg) | 120074115 | — | [ ] | [ ] | ['Apolipoprotein C2 deficiency'] |
| NM_000543.4(SMPD1): c.911T > C (p.Leu304Pro) | 120074124 | SMPD1 | ['CACYTGTGAGGAAGTTCCTGGGG1 | [AGCACYTGTGAGGAAGTTCCTGG', 'GCACYTGTGAGGAAGTTCCTGGG', 'CACYTGTGAGGAAGTTCCTGGGG'] | ['Sphingomyelin/cholesterol lipidosis', 'Niemann-Pick disease, type A', 'Niemann-Pick disease, type B', 'not provided'] |
| NM_000085.4(CLCNKB): c.1294T > C (p.Tyr432His) | 121909135 | CLCNKB | [ ] | ['CTTTGTCYATGGTGAGTCTGGGG'] | ['Bartter syndrome type 3'] |
| NM_001300.5(KLF6): c.346T > C (p.Ser116Pro) | 121909139 | KLF6 | [ ] | [ ] | [ ] |
| m.12338T > C | 201863060 | MT-NDS | [ ] | [ ] | ['Leber optic atrophy'] |
| NM_001300.5(KLF6): c.190T > C (p.Trp64Arg) | 121909142 | KLF6 | ['TCTGYGGACCAAAATCATTCTGG'] | ['TCTGYGGACCAAAATCATTCTGG'] | [ ] |
| NM_001300.5(KLF6): c.506T > C (p.Leu169Pro) | 121909143 | KLF6 | [ ] | ['GGAGCYGCCCTCGCCAGGGAAGG'] | [ ] |
| NM_000271.4(NPC1): c.337T > C (p.Cys113Arg) | 120074136 | NPC1 | [ ] | [ ] | ['Niemann-Pick disease type C1'] |
| NM_000019.3(ACAT1): c.935T > C (p.Ile312Thr) | 120074146 | ACAT1 | ['CAAGAAYAGTAGGTAAGGCAGG'] | ['CAAGAAYAGTAGGTAAGGCCAGG'] | ['Deficiency of acetyl-CoA acetyltransferase'] |
| NM_017890.4(VPS13B): c.8459T > C (p.Ile2820Thr) | 120074155 | VPS13B | [ ] | [ ] | ['Cohen syndrome'] |
| NM_017653.3(DYM): c.1624T > C (p.Cys542Arg) | 120074165 | DYM | [ ] | [ ] | ['Smith McCort dysplasia'] |
| NM_001089.2(ABCA3): c.302T > C (p.Leu101Pro) | 121909182 | ABCA3 | [ ] | ['GCACYTGTGATCAACATGCGAGG'] | ['Surfactant metabolism dysfunction, pulmonary, 3'] |
| NM_001089.2(ABCA3): c.4658T > C (p.Leu1553Pro) | 121909183 | ABCA3 | [ ] | [ ] | ['Surfactant metabolism dysfunction, pulmonary, 3'] |
| NM_001089.2(ABCA3): c.977T > C (p.Leu326Pro) | 121909185 | ABCA3 | [ ] | [ ] | ['Surfactant metabolism dysfunction, pulmonary, 3'] |
| NM_000474.3(TWIST1): c.392T > C (p.Leu131Pro) | 121909189 | TWIST1 | [ ] | [ ] | ['Saethre-Chotzen syndrome'] |
| NM_000503.5(EYA1): c.1459T > C (p.Ser487Pro) | 121909200 | EYA1 | [ ] | ['CACTCYCGCTCATTCACTCCCGG'] | ['Melnick-Fraser syndrome'] |
| NM_000358.2(TGFBI): c.1619T > C (p.Phe540Ser) | 121909214 | TGFBI | [ ] | [ ] | ['Lattice corneal dystrophy type 3A'] |
| NM_000426.3(LAMA2): c.8282T > C (p.Ile2761Thr) | 115650537 | LAMA2 | ['TTGAYAGGGAGCAA | ['TTGAYAGGGAGCAAGCAGTTCGG', 'TGAYAGGGAGCA | ['Merosin deficient congenital muscular dystrophy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | 'GCAGTTCGG', 'TGAYAGGGAGCAAGCAGTTCGGG'] | AGCAGTTCGGG'] | |
| NM_000314.6(PTEN): c.209T > C (p.Leu70Pro) | 121909226 | PTEN | [ ] | [ ] | ['Cowden syndrome 1', 'Hereditary cancer-predisposing syndrome'] |
| NM_000314.6(PTEN): c.335T > C (p.Leu112Pro) | 121909230 | PTEN | [ ] | [ ] | ['Lhermitte-Duclos disease'] |
| NM_000314.6(PTEN): c.722T > C (p.Phe241Ser) | 121909240 | PTEN | [ ] | [ ] | ['Macrocephaly/autism syndrome'] |
| NM_004970.2(IGFALS): c.1618T > C (p.Cys540Arg) | 121909247 | IGFALS | [ ] | ['GGACYGTGGCTGCCCTCTCAAGG'] | ['Acid-labile subunit deficiency'] |
| NM_005570.3(LMAN1): c.2T > C (p.Met1Thr) | 121909253 | LMAN1 | [ ] | [AGAYGGCGGGATCCAGGCAAAGG'] | ['Combined deficiency of factor V and factor VIII, 1'] |
| NM_005055.4(RAPSN): c.416T > C (p.Phe139Ser) | 121909256 | RAPSN | [ ] | [ ] | ['Pena-Shokeir syndrome type I'] |
| NM_000391.3(TPP1): c.887-10A > G | 755445790 | TPP1 | ['TTTYTTTTTTTTTTTTTTGAGG'] | ['TTTYTTTTTTTTTTTTTTGAGG'] | ['Ceroid lipofuscinosis, neuronal, 2', 'not provided'] |
| NM_006302.2(MOGS): c.1954T > C (p.Phe652Leu) | 121909292 | MOGS | [ ] | [ ] | ['Congenital disorder of glycosylation type 2B'] |
| NM_005379.3(MYO1A): c.2728T > C (p.Ser910Pro) | 121909306 | MYO1A | [ ] | [ ] | ['Deafness, autosomal dominant 48'] |
| NM_178151.2(DCX): c.128T > C (p.Leu43Ser) | 587783521 | DCX | [ ] | [ ] | ['Heterotopia'] |
| NM_001127221.1(CACNA1A): c.5126T > C (p.Ile1709Thr) | 121909326 | CACNA1A | [ ] | [ ] | ['Spinocerebellar ataxia 6', 'Familial hemiplegic migraine type 1', 'Episodic ataxia type 2'] |
| NM_001451.2(FOXF1): c.1138T > C (p.Ter380Arg) | 121909337 | FOXF1 | ['TGATGYGAGGCTGCCGCCGCAGG'] | ['TGATGYGAGGCTGCCGCCGCAGG'] | ['Alveolar capillary dysplasia with misalignment of pulmonary veins'] |
| NM_000163.4(GHR): c.341T > C (p.Phe114Ser) | 121909357 | GHR | [ ] | [ ] | ['Laron-type isolated somatotropin defect'] |
| NM_000163.4(GHR): c.512T > C (p.Ile171Thr) | 121909367 | GHR | [ ] | [ ] | ['Laron-type isolated somatotropin defect'] |
| NM_000339.2(SLC12A3): c.1868T > C (p.Leu623Pro) | 121909385 | SLC12A3 | [ ] | [CAACCYGGCCCTCAGCTACTCGG'] | ['Familial hypokalemia-hypomagnesemia'] |
| NM_001174089.1(SLC4A11): c.2480T > C (p.Leu827Pro) | 121909394 | SLC4A11 | [ ] | [ ] | ['Corneal dystrophy and perceptive deafness'] |
| NM_001174089.1(SLC4A11): c.589T > C (p.Ser197Pro) | 121909395 | SLC4A11 | [ ] | [ ] | ['Corneal dystrophy and perceptive deafness'] |
| NM_000519.3(HBD): c.-127T > C | 34975911 | HBD | [ ] | [ ] | ['delta Thalassemia'] |
| NM_002427.3(MMP13): c.224T > C (p.Phe75Ser) | 121909497 | MMP13 | [ ] | ['TTCTYCGGCTTAGAGGTGACTGG'] | ['Spondyloepimetaphyseal dysplasia, Missouri type'] |
| NM_002427.3(MMP13): c.221T > C (p.Phe74Ser) | 121909498 | MMP13 | [ ] | [ ] | [ ] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_002427.3(MMP13): c.272T > C (p.Met91Thr) | 121909499 | MMP13 | ['GTCAYGAAAAAGCCAAGATGCGG', 'TCAYGAAAAAGCCAAGATGCGGG'] | ['GTCAYGAAAAAGCCAAGATGCGG', 'TCAYGAAAAAGCCAAGATGCGGGG'] | [ ] |
| NM_000751.2(CHRND): c.283T > C (p.Phe95Leu) | 121909506 | CHRND | [ ] | [ ] | ['Lethal multiple pterygium syndrome'] |
| NM_000751.2(CHRND): c.188T > C (p.Leu63Pro) | 121909508 | CHRND | [ ] | ['AACCYCATCTCCCTGGTGAGAGG'] | ['MYASTHENIC SYNDROME, CONGENITAL, 3B, FAST-CHANNEL'] |
| NM_001100.3(ACTA1): c.287T > C (p.Leu96Pro) | 121909519 | ACTA1 | [ ] | ['CGAGCYTCGCGTGGCTCCCGAGG'] | ['Nemaline myopathy 3'] |
| NM_001100.3(ACTA1): c.668T > C (p.Leu223Pro) | 121909530 | ACTA1 | [ ] | [ ] | ['Congenital myopathy with fiber type disproportion'] |
| NM_000488.3(SERPINC1): c.1141T > C (p.Ser381Pro) | 121909565 | SERPINC1 | [ ] | [ ] | ['Antithrombin III deficiency'] |
| NM_000488.3(SERPINC1): c.442T > C (p.Ser148Pro) | 121909569 | SERPINC1 | [ ] | [ ] | ['Antithrombin III deficiency'] |
| NM_000488.3(SERPINC1): c.667T > C (p.Ser223Pro) | 121909572 | SERPINC1 | [ ] | ['TGGGTGYCCAATAAGACCGAAGG'] | ['Antithrombin III deficiency'] |
| NM_000488.3(SERPINC1): c.379T > C (p.Cys127Arg) | 121909573 | SERPINC1 | [ ] | [ ] | ['Antithrombin III deficiency'] |
| NM_023110.2(FGFR1): c.899T > C (p.Ile300Thr) | 121909633 | FGFR1 | [ ] | [ ] | ['Interfrontal craniofaciosynostosis'] |
| NM_023110.2(FGFR1): c.1141T > C (p.Cys381Arg) | 121909634 | FGFR1 | [ ] | [ ] | ['Osteoglophonic dysplasia'] |
| NM_182925.4(FLT4): c.3131T > C (p.Leu1044Pro) | 121909651 | FLT4 | [ ] | [ ] | ['Hereditary lymphedema type I'] |
| NM_182925.4(FLT4): c.3257T > C (p.Ile1086Thr) | 121909655 | FLT4 | [ ] | [ ] | ['Hereditary lymphedema type I'] |
| NM_000145.3(FSHR): c.479T > C (p.Ile160Thr) | 121909659 | FSHR | [ ] | [ ] | ['Ovarian dysgenesis 1'] |
| NM_000145.3(FSHR): c.1634T > C (p.Ile545Thr) | 121909664 | FSHR | [ ] | [ ] | ['Ovarian hyperstimulation syndrome'] |
| NM_000821.6(GGCX): c.896T > C (p.Phe299Ser) | 121909677 | GGCX | [ ] | ['TATGTYCTCCTACGTCATGCTGG'] | ['Pseudoxanthoma elasticum-like disorder with multiple coagulation factor deficiency'] |
| NM_001018077.1(NR3C1): c.2209T > C (p.Phe737Leu) | 121909727 | NR3C1 | [ ] | ['CTATTGCYTCCAAACATTTTTGG'] | ['Glucocorticoid resistance, generalized'] |
| NM_005271.3(GLUD1): c.1501T > C (p.Ser501Pro) | 121909732 | GLUD1 | [ ] | [ ] | ['Hyperinsulinism-hyperammonemia syndrome'] |
| NM_004614.4(TK2): c.278A > G (p.Asn93Ser) | 142291440 | TK2 | [ ] | [ ] | ['Mitochondrial DNA depletion syndrome 2'] |
| NM_032977.3(CASP10): c.440T > C (p.Met147Thr) | 121909776 | CASP10 | [ ] | [ ] | ['Neoplasm of stomach'] |
| NM_000250.1(MPO): c.518A > G (p.Tyr173Cys) | 78950939 | MPO | ['TGCGGYATTTGTCC | ['GTGCGGYATTTGTCCTGCTCCGG', 'TGCGGYATTTGT | ['Myeloperoxidase deficiency'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
|  |  |  | TGCTC CGGG'] | CCTGCTCCGGG'] |  |
| NM_001139.2(ALOX12B): c.1562A > G (p.Tyr521Cys) | 199766569 | ALOX12B | [ ] | [ ] | ['Autosomal recessive congenital ichthyosis 2'] |
| NM_022041.3(GAN): c.1268T > C (p.Ile423Thr) | 119485091 | GAN | ['AAGA AAAYC TACGC CATGG GTGG'] | ['AAGAAAAYCTA CGCCATGGGTGG', 'AAAAYCTACGCC ATGGGTGGAGG'] | ['Giant axonal neuropathy'] |
| NM_014009.3(FOXP3): c.970T > C (p.Phe324Leu) | 122467173 | FOXP3 | ['GACA GAGYT CCTCC ACAAC ATGG'] | ['GACAGAGYTCCT CCACAACATGG'] | ['Insulin-dependent diabetes mellitus secretory diarrhea syndrome'] |
| NM_014009.3(FOXP3): c.1099T > C (p.Phe367Leu) | 122467175 | FOXP3 | [ ] | [ ] | ['Insulin-dependent diabetes mellitus secretory diarrhea syndrome'] |
| NM_004239.3(TRIP11): c.2102A > G (p.Asn701Ser) | 139539448 | TRIP11 | [ ] | [ ] | ['Achondrogenesis, type IA'] |
| NM_001104.3(ACTN3): c.1729C > T (p.Arg577Ter) | 1815739 | ACTN3 | [ ] | [ ] | ['Sprinting performance', 'Actn3 deficiency'] |
| NM_002693.2(POLG): c.2636A > G (p.Gln879Arg) | 368587966 | POLG | [ ] | [ ] | ['not provided'] |
| NM_000552.3(VWF): c.3178T > C (p.Cys1060Arg) | 61748497 | VWF | [ ] | [ ] | ['von Willebrand disease type 2N', 'not provided'] |
| NM_000552.3(VWF): c.3445T > C (p.Cys1149Arg) | 61748511 | VWF | [ ] | [ ] | ['von Willebrand disease type 1', 'not provided'] |
| NM_000184.2(HBG2): c.125T > C (p.Phe42Ser) | 34878913 | HBG2 | ['CAGA GGTYC TTTGA CAGCT TTGG'] | ['CAGAGGTYCTTT GACAGCTTTGG'] | ['Cyanosis, transient neonatal'] |
| NM_000371.3(TTR): c.190T > C (p.Phe64Leu) | 138065384 | TTR | [ ] | [ ] | ['Cardiomyopathy', 'not specified'] |
| NM_000402.4(G6PD): c.1058T > C (p.Leu353Pro) | 76723693 | G6PD | [ ] | [ ] | ['Glucose 6 phosphate dehydrogenase deficiency', 'Anemia, nonspherocytic hemolytic, due to G6PD deficiency', 'not provided'] |
| NM_177405.2(CECR1): c.355A > G (p.Thr119Ala) | 775440641 | CECR1 | [ ] | [ ] | ['Idiopathic livedo reticularis with systemic involvement'] |
| NM_000218.2(KCNQ1): c.401T > C (p.Leu134Pro) | 199472685 | KCNQ1 |  |  | ['Congenital long QT syndrome', 'Cardiac arrhythmia'] |
| NM_000218.2(KCNQ1): c.625T > C (p.Ser209Pro) | 199472705 | KCNQ1 |  |  | ['Atrial fibrillation, familial, 3', 'Atrial fibrillation'] |
| NM_000218.2(KCNQ1): c.752T > C (p.Leu251Pro) | 199472716 | KCNQ1 |  |  | ['Congenital long QT syndrome', 'Cardiac arrhythmia', 'Long QT syndrome, LQT1 subtype'] |
| NM_000218.2(KCNQ1): c.824T > C (p.Phe275Ser) | 199472729 | KCNQ1 |  |  | ['Congenital long QT syndrome', 'Long QT syndrome, LQT1 subtype'] |
| NM_000218.2(KCNQ1): c.832T > C (p.Tyr278His) | 199472731 | KCNQ1 |  |  | ['Congenital long QT syndrome'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000218.2(KCNQ1):<br>c.845T > C<br>(p.Leu282Pro) | 199472733 | KCNQ1 | | | ['Congenital long<br>QT syndrome'] |
| NM_000257.3(MYH7):<br>c.730T > C<br>(p.Phe244Leu) | 730880849 | MYH7 | [ ] | [ ] | ['Cardiomyopathy'] |
| NM_000218.2(KCNQ1):<br>c.908T > C<br>(p.Leu303Pro) | 199472740 | KCNQ1 | | | ['Congenital long<br>QT syndrome'] |
| NM_000218.2(KCNQ1):<br>c.913T > C<br>(p.Trp305Arg) | 199472741 | KCNQ1 | | | ['Congenital long<br>QT syndrome',<br>'Long QT syndrome,<br>LQT1 subtype'] |
| NM_000218.2(KCNQ1):<br>c.1045T > C<br>(p.Ser349Pro) | 199472764 | KCNQ1 | | | ['Congenital long<br>QT syndrome',<br>'Long QT syndrome,<br>LQT1 subtype'] |
| NM_000218.2(KCNQ1):<br>c.1117T > C<br>(p.Ser373Pro) | 199472766 | KCNQ1 | | | ['Congenital long<br>QT syndrome'] |
| NM_000218.2(KCNQ1):<br>c.1165T > C<br>(p.Ser389Pro) | 199472772 | KCNQ1 | | | ['Congenital long<br>QT syndrome'] |
| NM_000218.2(KCNQ1):<br>c.1174T > C<br>(p.Trp392Arg) | 199472774 | KCNQ1 | | | ['Congenital long<br>QT syndrome'] |
| NM_000218.2(KCNQ1):<br>c.1541T > C<br>(p.Ile514Thr) | 199472786 | KCNQ1 | | | ['Congenital long<br>QT syndrome',<br>'Long QT syndrome,<br>LQT1 subtype'] |
| NM_000218.2(KCNQ1):<br>c.1696T > C<br>(p.Ser566Pro) | 199472803 | KCNQ1 | | | ['Congenital long<br>QT syndrome'] |
| NM_000218.2(KCNQ1):<br>c.1805T > C<br>(p.Leu602Pro) | 199472818 | — | | | ['Congenital long<br>QT syndrome'] |
| NM_000218.2(KCNQ1):<br>c.608T > C<br>(p.Leu203Pro) | 199472823 | KCNQ1 | | | ['Congenital long<br>QT syndrome',<br>'Cardiac arrhythmia'] |
| NM_000238.3(KCNH2):<br>c.65T > C<br>(p.Phe22Ser) | 199472826 | KCNH2 | | | ['Congenital long<br>QT syndrome'] |
| NM_000238.3(KCNH2):<br>c.86T > C<br>(p.Phe29Ser) | 199472831 | KCNH2 | | | ['Congenital long<br>QT syndrome'] |
| NM_000238.3(KCNH2):<br>c.89T > C<br>(p.Ile30Thr) | 199472832 | KCNH2 | | | ['Congenital long<br>QT syndrome'] |
| NM_000238.3(KCNH2):<br>c.160T > C<br>(p.Tyr54His) | 199472843 | KCNH2 | | | ['Congenital long<br>QT syndrome'] |
| NM_001165963.1(SCN1A):<br>c.662T > C<br>(p.Leu221Pro) | 796052961 | SCN1A | [ ] | [ ] | ['not provided'] |
| NM_000238.3(KCNH2):<br>c.287T > C<br>(p.Ile96Thr) | 199472853 | KCNH2 | | | ['Congenital long<br>QT syndrome'] |
| NM_000238.3(KCNH2):<br>c.322T > C<br>(p.Cys108Arg) | 199472859 | KCNH2 | | | ['Congenital long<br>QT syndrome'] |
| NM_000238.3(KCNH2):<br>c.872T > C<br>(p.Met291Thr) | 199472881 | KCNH2 | | | ['Congenital long<br>QT syndrome'] |
| NM_000238.3(KCNH2):<br>c.1238T > C<br>(p.Leu413Pro) | 199472893 | KCNH2 | | | ['Congenital long<br>QT syndrome'] |
| NM_000238.3(KCNH2):<br>c.1279T > C<br>(p.Tyr427His) | 199472898 | KCNH2 | | | ['Congenital long<br>QT syndrome'] |
| NM_000238.3(KCNH2):<br>c.1387T > C<br>(p.Phe463Leu) | 199472904 | KCNH2 | | | ['Congenital long<br>QT syndrome'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000238.3(KCNH2):<br>c.1655T > C<br>(p.Leu552Ser) | 199472918 | KCNH2 | [ ] | [ ] | ['Congenital long QT syndrome', 'Cardiac arrhythmia'] |
| NM_000061.2(BTK):<br>c.1955T > C<br>(p.Leu652Pro) | 128622212 | BTK | [ ] | [ ] | ['X-linked agammaglobulinemia'] |
| NM_000238.3(KCNH2):<br>c.1691T > C<br>(p.Leu564Pro) | 199472924 | KCNH2 | | | ['Congenital long QT syndrome'] |
| NM_000238.3(KCNH2):<br>c.1702T > C<br>(p.Trp568Arg) | 199472927 | KCNH2 | | | ['Congenital long QT syndrome'] |
| NM_000138.4(FBN1):<br>c.5726T > C<br>(p.Ile1909Thr) | 794728333 | FBN1 | [ ] | [ ] | ['Thoracic aortic aneurysms and aortic dissections'] |
| NM_015884.3(MBTPS2):<br>c.1424T > C<br>(p.Phe475Ser) | 122468179 | MBTPS2 | [ ] | [ ] | ['IFAP syndrome with or without BRESHECK syndrome'] |
| NM_000238.3(KCNH2):<br>c.1985T > C<br>(p.Ile662Thr) | 199472980 | KCNH2 | | | ['Congenital long QT syndrome'] |
| NM_000238.3(KCNH2):<br>c.2033T > C<br>(p.Leu678Pro) | 199472981 | KCNH2 | | | ['Congenital long QT syndrome'] |
| NM_000238.3(KCNH2):<br>c.2078T > C<br>(p.Leu693Pro) | 199472983 | KCNH2 | | | ['Congenital long QT syndrome', 'Cardiac arrhythmia'] |
| NM_000238.3(KCNH2):<br>c.2309T > C<br>(p.Val770Ala) | 199472994 | KCNH2 | | | ['Congenital long QT syndrome'] |
| NM_000238.3(KCNH2):<br>c.3146T > C<br>(p.Leu1049Pro) | 199473026 | KCNH2 | | | ['Congenital long QT syndrome'] |
| NM_000335.4(SCN5A):<br>c.278T > C<br>(p.Phe93Ser) | 199473052 | SCN5A | | | ['Brugada syndrome'] |
| NM_000335.4(SCN5A):<br>c.544T > C<br>(p.Cys182Arg) | 199473066 | SCN5A | | | ['Brugada syndrome'] |
| NM_000335.4(SCN5A):<br>c.689T > C<br>(p.Ile230Thr) | 199473073 | SCN5A | | | ['Cardiac conduction defect, nonspecific'] |
| NM_000335.4(SCN5A):<br>c.1187T > C<br>(p.Val396Ala) | 199473103 | SCN5A | | | ['Brugada syndrome'] |
| NM_000335.4(SCN5A):<br>c.1190T > C<br>(p.Ile397Thr) | 199473105 | SCN5A | | | ['Congenital long QT syndrome'] |
| NM_000335.4(SCN5A):<br>c.2018T > C<br>(p.Leu673Pro) | 199473141 | SCN5A | | | ['Congenital long QT syndrome'] |
| NM_000335.4(SCN5A):<br>c.2516T > C<br>(p.Leu839Pro) | 199473164 | SCN5A | | | ['Brugada syndrome'] |
| NM_000335.4(SCN5A):<br>c.2783T > C<br>(p.Leu928Pro) | 199473178 | SCN5A | | | ['Brugada syndrome'] |
| NM_000335.4(SCN5A):<br>c.2804T > C<br>(p.Leu935Pro) | 199473179 | SCN5A | | | ['Brugada syndrome'] |
| NM_198056.2(SCN5A):<br>c.3010T > C<br>(p.Cys1004Arg) | 199473183 | SCN5A | [ ] | [ ] | ['Congenital long QT syndrome', 'not specified', 'not provided'] |
| NM_000335.4(SCN5A):<br>c.3679T > C<br>(p.Tyr1227His) | 199473205 | SCN5A | [ ] | [ ] | ['Brugada syndrome'] |
| NM_000335.4(SCN5A):<br>c.3713T > C<br>(p.Leu1238Pro) | 199473210 | SCN5A | | | ['Brugada syndrome'] |
| NM_000492.3(CFTR):<br>c.1400T > C | 139573311 | CFTR | [ ] | ['TTCACYTCTAAT GGTGATTATGG', | ['Cystic fibrosis'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Leu467Pro) | | | | 'TCACYTCTAATG GTGATTATGGG' | |
| NM_000335.4(SCN5A): c.3929T > C (p.Leu1310Pro) | 199473219 | SCN5A | | | ['Brugada syndrome'] |
| NM_000335.4(SCN5A): c.4027T > C (p.Phe1343Leu) | 199473228 | SCN5A | | | ['Brugada syndrome'] |
| NM_000335.4(SCN5A): c.4028T > C (p.Phe1343Ser) | 199473229 | SCN5A | | | ['Brugada syndrome'] |
| NM_000335.4(SCN5A): c.4034T > C (p.Leu1345Pro) | 199473231 | SCN5A | | | ['Brugada syndrome'] |
| NM_000335.4(SCN5A): c.4340T > C (p.Ile1447Thr) | 199473251 | SCN5A | | | ['Brugada syndrome'] |
| NM_198056.2(SCN5A): c.4493T > C (p.Met1498Thr) | 199473263 | SCN5A | | | ['Congenital long QT syndrome', 'not provided'] |
| NM_000335.4(SCN5A): c.4742T > C (p.Leu1581Pro) | 199473275 | SCN5A | | | ['Brugada syndrome'] |
| NM_000335.4(SCN5A): c.4778T > C (p.Phe1593Ser) | 199473277 | SCN5A | | | ['Congenital long QT syndrome'] |
| NM_000335.4(SCN5A): c.5179T > C (p.Cys1727Arg) | 199473302 | SCN5A | | | ['Brugada syndrome'] |
| NM_000219.5(KCNE1): c.158T > C (p.Phe53Ser) | 199473355 | KCNE1 | | | ['Congenital long QT syndrome'] |
| NM_000219.5(KCNE1): c.259T > C (p.Trp87Arg) | 199473361 | KCNE1 | | | ['Congenital long QT syndrome'] |
| NM_000891.2(KCNJ2): c.301T > C (p.Cys101Arg) | 199473374 | KCNJ2 | | | ['Ventricular tachycardia'] |
| NM_000218.2(KCNQ1): c.560T > C (p.Leu187Pro) | 199473399 | KCNQ1 | [ ] | [ ] | ['Congenital long QT syndrome', 'Cardiac arrhythmia', 'Long QT syndrome, LQT1 subtype'] |
| NM_000218.2(KCNQ1): c.572T > C (p.Leu191Pro) | 199473401 | KCNQ1 | | | ['Congenital long QT syndrome', 'Long QT syndrome, LQT1 subtype'] |
| NM_000218.2(KCNQ1): c.1052T > C (p.Phe351Ser) | 199473402 | KCNQ1 | | | ['Congenital long QT syndrome', 'Long QT syndrome, LQT1 subtype'] |
| NM_000218.2(KCNQ1): c.1058T > C (p.Leu353Pro) | 199473403 | KCNQ1 | | | ['Congenital long QT syndrome', 'Cardiac arrhythmia', 'Long QT syndrome, LQT1 subtype'] |
| NM_000238.3(KCNH2): c.202T > C (p.Phe68Leu) | 199473417 | KCNH2 | | | ['Congenital long QT syndrome', 'Cardiac arrhythmia'] |
| NM_000218.2(KCNQ1): c.341T > C (p.Leu114Pro) LQT1 | 199473448 | KCNQ1 | | | ['Congenital long QT syndrome', 'Long QT syndrome, subtype'] |
| NM_000218.2(KCNQ1): c.716T > C (p.Leu239Pro) LQT1 | 199473458 | KCNQ1 | | | ['Congenital long QT syndrome', 'Long QT syndrome, subtype'] |
| NM_000218.2(KCNQ1): c.742T > C (p.Trp248Arg) | 199473459 | KCNQ1 | | | ['Congenital long QT syndrome', 'Cardiac arrhythmia'] |
| NM_000218.2(KCNQ1): c.797T > C (p.Leu266Pro) | 199473460 | KCNQ1 | | | ['Long QT syndrome', 'Congenital long QT |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | | | syndrome', 'Cardiac arrhythmia'] |
| NM_000218.2(KCNQ1): c.829T > C (p.Ser277Pro) | 199473461 | KCNQ1 | | | ['Congenital long QT syndrome'] |
| NM_000218.2(KCNQ1): c.910T > C (p.Trp304Arg) | 199473466 | KCNQ1 | | | ['Congenital long QT syndrome', 'Long QT syndrome, LQT1 subtype'] |
| NM_000218.2(KCNQ1): c.1550T > C (p.Ile517Thr) | 199473478 | KCNQ1 | | | ['Congenital long QT syndrome'] |
| NM_000218.2(KCNQ1): c.1661T > C (p.Val554Ala) | 199473481 | KCNQ1 | | | ['Congenital long QT syndrome', 'Long QT syndrome, LQT1 subtype'] |
| NM_000218.2(KCNQ1): c.2T > C (p.Met1Thr) | 199473485 | KCNQ1 | | | ['Congenital long QT syndrome', 'KCNQ1-related Jervell and Lange-Nielsen syndrome'] |
| NM_000238.3(KCNH2): c.260T > C (p.Leu87Pro) | 199473495 | KCNH2 | | | ['Congenital long QT syndrome'] |
| NM_000238.3(KCNH2): c.1700T > C (p.Ile567Thr) | 199473519 | KCNH2 | | | ['Congenital long QT syndrome'] |
| NM_000238.3(KCNH2): c.1705T > C (p.Tyr569His) | 199473520 | KCNH2 | | | ['Congenital long QT syndrome'] |
| NM_000238.3(KCNH2): c.1816T > C (p.Ser606Pro) | 199473523 | KCNH2 | | | ['Congenital long QT syndrome'] |
| NM_000238.3(KCNH2): c.1889T > C (p.Val630Ala) | 199473526 | KCNH2 | | | ['Congenital long QT syndrome'] |
| NM_000238.3(KCNH2): c.1945T > C (p.Ser649Pro) | 199473530 | KCNH2 | | | ['Congenital long QT syndrome'] |
| NM_000238.3(KCNH2): c.2452T > C (p.Ser818Pro) | 199473537 | KCNH2 | | | ['Congenital long QT syndrome'] |
| NM_000238.3(KCNH2): c.2573T > C (p.Ile858Thr) | 199473539 | KCNH2 | | | ['Congenital long QT syndrome'] |
| NM_000335.4(SCN5A): c.407T > C (p.Leu136Pro) | 199473557 | SCN5A | | | ['Brugada syndrome'] |
| NM_020166.4(MCCC1): c.1310T > C (p.Leu437Pro) | 119103215 | MCCC1 | [ ] | [ ] | ['3 Methylcrotonyl-CoA carboxylase 1 deficiency'] |
| NM_198056.2(SCN5A): c.944T > C (p.Leu315Pro) | 199473564 | SCN5A | | | ['Brugada syndrome', 'not provided'] |
| NM_002972.3(SBF1): c.1249A > G (p.Met417Val) | 587776986 | SBF1 | [ ] | [ ] | ['Charcot-Marie-Tooth disease, type 4B3'] |
| NM_000335.4(SCN5A): c.2551T > C (p.Phe851Leu) | 199473586 | SCN5A | | | ['Brugada syndrome'] |
| NM_000335.4(SCN5A): c.2743T > C (p.Cys915Arg) | 199473588 | SCN5A | | | ['Brugada syndrome'] |
| NM_000335.4(SCN5A): c.4046T > C (p.Ile1349Thr) | 199473607 | SCN5A | | | ['Brugada syndrome'] |
| NM_000335.4(SCN5A): c.4453T > C (p.Phe1485Leu) | 199473615 | SCN5A | | | ['Sudden infant death syndrome'] |
| NM_000335.4(SCN5A): c.5111T > C (p.Phe1704Ser) | 199473627 | SCN5A | | | ['Sudden infant death syndrome'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000891.2(KCNJ2): c.650T > C (p.Leu217Pro) | 199473656 | KCNJ2 | | | ['Congenital long QT syndrome'] |
| NM_000218.2(KCNQ1): c.550T > C (p.Tyr184His) | 199473661 | KCNQ1 | ['AGCAAGBACGTGGGCCTCTGGGG'] | ['CAGCAAGBACGTGGGCCTCTGGG', 'AGCAAGBACGTGGGCCTCTGGGG', 'GCAAGBACGTGGCCTCTGGGGG'] | ['Congenital long QT syndrome', 'Cardiac arrhythmia'] |
| NM_000238.3(KCNH2): c.206T > C (p.Leu69Pro) | 199473665 | KCNH2 | | | ['Congenital long QT syndrome'] |
| NM_001130823.1(DNMT1): c.1531T > C (p.Tyr511His) | 199473692 | DNMT1 | | | ['Hereditary sensory neuropathy type IE'] |
| NM_031226.2(CYP19A1): c.743 + 2T > C | 786205107 | — | ['CTGTGYAAGTAATACAACTTTGG'] | ['CTGTGYAAGTAATACAACTTTGG'] | ['Aromatase deficiency'] |
| NM_016373.3(WW0X): c.872T > C (p.Leu291Pro) | 119487098 | WWOX | [ ] | [ ] | [ ] |
| NM_001287223.1(SCN11A): c.1142T > C (p.Ile381Thr) | 606231280 | SCN11A | ['TTCAYTGTGGTCATTTTCCTGGG'] | ['CTTCAYTGTGGTCATTTTCCTGG', 'TTCAYTGTGGTCATTTTCCTGGG'] | ['Episodic pain syndrome, familial, 3'] |
| NM_003640.3(IKBKAP): c.2204 + 6T > C | 111033171 | IKBKAP | [ ] | [ ] | ['Familial dysautonomia', 'not provided'] |
| NM_000238.3(KCNH2): c.1282T > C (p.Ser428Pro) | 794728368 | KCNH2 | [ ] | [ ] | ['Cardiac arrhythmia'] |
| NM_000441.1(SLC26A4): c.1588T > C (p.Tyr530His) | 111033254 | SLC26A4 | [ ] | [ ] | ['Pendred syndrome', 'Enlarged vestibular aqueduct syndrome'] |
| NM_206933.2(USH2A): c.10561T > C (p.Trp3521Arg) | 111033264 | USH2A | [ ] | [ ] | ['Usher syndrome, type 2A'] |
| NM_206933.2(USH2A): c.1606T > C (p.Cys536Arg) | 111033273 | USH2A | ['ATATAGAYGCCTCTGCTCCCAGG'] | ['ATATAGAYGCCTCTGCTCCCAGG'] | ['Usher syndrome, type 2A'] |
| NM_001363.4(DKC1): c.1049T > C (p.Met350Thr) | 121912300 | DKC1 | [ ] | [ ] | ['Dyskeratosis congenita X-linked'] |
| NM_000274.3(OAT): c.1180T > C (p.Cys394Arg) | 121965054 | OAT | [ ] | [ ] | [Ornithine aminotransferase deficiency'] |
| NM_001302946.1(TRNT1): c.497T > C (p.Leu166Ser) | 606231289 | TRNT1 | ['ACTTYATTTGACTACTTTAATGG'] | ['ACTTYATTTGACTACTTTAATGG'] | ['Sideroblastic anemia with B-cell immunodeficiency, periodic fevers, and developmental delay'] |
| NM_000454.4(SOD1): c.341T > C (p.Ile114Thr) | 121912441 | SOD1 | [ ] | ['CATCAYTGGCCGCACACTGGTGG'] | ['Amyotrophic lateral sclerosis type 1'] |
| NM_000454.4(SOD1): c.434T > C (p.Leu145Ser) | 121912446 | SOD1 | [ ] | ['CGTTYGGCTTGTGGTGTAATTGG', 'GTTYGGCTTGTGGTGTAATTGGG'] | ['Amyotrophic lateral sclerosis type 1'] |
| NM_000454.4(SOD1): c.455T > C (p.Ile152Thr) | 121912449 | SOD1 | [ ] | [ ] | ['Amyotrophic lateral sclerosis type 1'] |
| NM_000213.3(ITGB4): c.467T > C (p.Leu156Pro) | 121912461 | ITGB4 | [ ] | [ ] | ['Epidermolysis bullosa with pyloric atresia'] |
| NM_000213.3(ITGB4): c.1684T > C (p.Cys562Arg) | 121912463 | ITGB4 | [ ] | ['GGCCAGYGTGTGTGTGAGCCTGG'] | ['Epidermolysis bullosa with pyloric atresia'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000213.3(ITGB4): c.112T > C (p.Cys38Arg) | 121912465 | ITGB4 | [ ] | [ ] | ['Epidermolysis bullosa with pyloric atresia'] |
| NM_002198.2(IRF1): c.31T > C (p.Trp11Arg) | 121912470 | IRF1 | [ ] | [ ] | ['Non-small cell lung cancer'] |
| NM_000424.3(KRT5): c.20T > C (p.Val7Ala) | 121912474 | KRT5 | ['TCAAGTGYGTCCTTCCGGAGCGG', 'CAAGTGYGTCCTTCCGGAGCGGG', 'AAGTGYGTCCTTCCGGAGCGGGG', 'AGTGYGTCCTTCCGGAGCGGGGG'] | ['TCAAGTGYGTCCTTCCGGAGCGG', 'CAAGTGYGTCCTTCCGGAGCGGG', 'AAGTGYGTCCTTCCGGAGCGGGG', 'AGTGYGTCCTTCCGGAGCGGGGG'] | ['Epidermolysis bullosa simplex, Koebner type'] |
| NM_002292.3(LAMB2): c.961T > C (p.Cys321Arg) | 121912492 | LAMB2 | [ ] | [CCTCAACYGCGAGCAGTGTCAGG] | ['Nephrotic syndrome, type 5, with or without ocular abnormalities'] |
| NM_170707.3(LMNA): c.1139T > C (p.Leu380Ser) | 121912495 | LMNA | ['TCTYGGAGGGCGAGGAGGAGAGG'] | ['TCTYGGAGGGCGAGGAGGAGAGG'] | ['Congenital muscular dystrophy, LMNA-related', 'not provided'] |
| NM_001399.4(EDA): c.2T > C (p.Met1Thr) | 397516659 | EDA | [ ] | ['GGCCAYGGGCTACCCGGAGGTGG'] | ['Hypohidrotic X-linked ectodermal dysplasia'] |
| NM_000493.3(COL10A1): c.1951T > C (p.Trp651Arg) | 111033549 | — | [ ] | [ ] | ['Metaphyseal chondrodysplasia, Schmid type'] |
| NM_000233.3(LHCGR): c.1193T > C (p.Met398Thr) | 121912526 | — | [ ] | [ ] | ['Gonadotropin-independent familial sexual precocity'] |
| NM_000233.3(LHCGR): c.391T > C (p.Cys131Arg) | 121912527 | — | [ ] | [ ] | ['Leydig cell hypoplasia, partial'] |
| NM_000493.3(COL10A1): c.1798T > C (p.Ser600Pro) | 111033555 | — | [ ] | [ ] | ['Metaphyseal chondrodysplasia, Schmid type'] |
| NM_000233.3(LHCGR): c.1103T > C (p.Leu368Pro) | 121912533 | — | [ ] | [ ] | ['Gonadotropin-independent familial sexual precocity'] |
| NM_000233.3(LHCGR): c.1627T > C (p.Cys543Arg) | 121912537 | — | [ ] | [ ] | ['Leydig cell agenesis'] |
| NM_000233.3(LHCGR): c.1505T > C (p.Leu502Pro) | 121912538 | — | [ ] | [ ] | ['Leydig cell agenesis'] |
| NM_000901.4(NR3C2): c.2771T > C (p.Leu924Pro) | 121912563 | NR3C2 | [ ] | [ ] | ['Pseudohypoaldosteronism type 1 autosomal dominant'] |
| NM_021044.2(DHH): c.485T > C (p.Leu162Pro) | 111033589 | DHH | [ ] | ['GTTGCYGGCGCGCCTCGCAGTGG'] | ['46,XY gonadal dysgenesis, complete, dhh-related'] |
| NM_000901.4(NR3C2): c.2936T > C (p.Leu979Pro) | 121912567 | NR3C2 | [ ] | [ ] | ['Pseudohypoaldosteronism type 1 autosomal dominant'] |
| NM_000517.4(HBA2): c.2T > C (p.Met1Thr) | 111033603 | HBA2 | [ ] | [ ] | ['alpha Thalassemia'] |
| NM_000762.5(CYP2A6): c.670T > C (p.Ser224Pro) | 111033610 | — | [ ] | [ ] | ['Tegafur response'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000660.5(TGFB1): c.241T > C (p.Tyr81His) | 111033611 | TGFB1 | [ ] | [ ] | ['Diaphyseal dysplasia'] |
| NM_001173464.1(KIF21A): c.1067T > C (p.Met356Thr) | 121912588 | KIF21A | [ ] | [ ] | ['Fibrosis of extraocular muscles, congenital, 1'] |
| NM_000206.2(IL2RG): c.343T > C (p.Cys115Arg) | 111033622 | IL2RG | [ ] | ['TGGCYGTCAGTT GCAAAAAAAGG'] | ['X-linked severe combined immunodeficiency'] |
| NM_001041.3(SI): c.1859T > C (p.Leu620Pro) | 121912613 | SI | [ ] | ['ATGCYGGAGTTC AGTTTGTTTGG'] | ['Sucrase-isomaltase deficiency'] |
| NM_016180.4(SLC45A2): c.1082T > C (p.Leu361Pro) | 121912619 | SLC45A2 | [ ] | ['GAGTTTCYCATC TACGAAAGAGG'] | ['Oculocutaneous albinism type 4', 'not provided'] |
| NM_000552.3(VWF): c.4837T > C (p.Ser1613Pro) | 61750581 | VWF | [ ] | ['CTGCCYCTGATG AGATCAAGAGG'] | ['von Willebrand disease, type 2a', 'not provided'] |
| NM_000552.3(VWF): c.4883T > C (p.Ile1628Thr) | 61750584 | VWF | [ ] | [ ] | ['von Willebrand disease, type 2a', 'not provided'] |
| NM_000180.3(GUCY2D): c.1694T > C (p.Phe565Ser) | 61749755 | GUCY2D | [ ] | [ ] | ['Leber congenital amaurosis 1', 'not provided'] |
| NM_003235.4(TG): c.3733T > C (p.Cys1245Arg) | 121912647 | TG | [ ] | [ ] | ['Iodotyrosyl coupling defect'] |
| NM_000546.5(TP53): c.755T > C (p.Leu252Pro) | 121912653 | TP53 | [ ] | ['CATCCYCACCAT CATCACACTGG'] | ['Li-Fraumeni syndrome 1'] |
| NM_000155.3(GALT): c.350T > C (p.Phe117Ser) | 111033679 | GALT | [ ] | [ ] | ['Deficiency of UDPglucose-hexose-1-phosphate uridylyltransferase'] |
| NM_000155.3(GALT): c.374T > C (p.Val125Ala) | 111033680 | GALT | [ ] | [ ] | ['Deficiency of UDPglucose-hexose-1-phosphate uridylyltransferase'] |
| NM_000155.3(GALT): c.386T > C (p.Met129Thr) | 111033683 | GALT | [ ] | ['AGGTCAYGTGCT TCCACCCCTGG'] | ['Deficiency of UDPglucose-hexose-1-phosphate uridylyltransferase'] |
| NM_000546.5(TP53): c.1031T > C (p.Leu344Pro) | 121912662 | TP53 | [ ] | [ ] | ['Li-Fraumeni syndrome 1'] |
| NM_000155.3(GALT): c.416T > C (p.Leu139Pro) | 111033687 | GALT | [ ] | [ ] | ['Deficiency of UDPglucose-hexose-1-phosphate uridylyltransferase'] |
| NM_000155.3(GALT): c.452T > C (p.Val151Ala) | 111033701 | GALT | [ ] | [ ] | ['Deficiency of UDPglucose-hexose-1-phosphate uridylyltransferase'] |
| NM_000155.3(GALT): c.499T > C (p.Trp167Arg) | 111033708 | GALT | ['CCCTY GGGTG CAGGT TTGTG AGG'] | ['CCCTYGGGTGCA GGTTTGTGAGG'] | ['Deficiency of UDPglucose-hexose-1-phosphate uridylyltransferase'] |
| NM_000155.3(GALT): c.507 + 2T > C | 111033710 | GALT | [ ] | [ ] | ['Deficiency of UDPglucose-hexose-1-phosphate uridylyltransferase'] |
| NM_000155.3(GALT): c.512T > C (p.Phe171Ser) | 111033715 | GALT | [ ] | [ ] | ['Deficiency of UDPglucose-hexose-1-phosphate uridylyltransferase'] |
| NM_000341.3(SLC3A1): c.2033T > C (p.Leu678Pro) | 121912693 | — | [ ] | [ ] | ['Cystinuria'] |
| NM_000540.2(RYR1): c.9242T > C (p.Met3081Thr) | 147012990 | RYR1 | [ ] | [ ] | ['Minicore myopathy with external ophthalmoplegia'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000155.3(GALT):<br>c.584T > C<br>(p.Leu195Pro) | 111033728 | GALT | [ ] | [ ] | ['Deficiency of UDPglucose-hexose- 1-phosphate uridylyltransferase'] |
| NM_000155.3(GALT):<br>c.650T > C<br>(p.Leu217Pro) | 111033741 | GALT | [ ] | [ ] | ['Deficiency of UDPglucose-hexose- 1-phosphate uridylyltransferase'] |
| NM_000155.3(GALT):<br>c.687 + 2T > C | 111033748 | GALT | [ ] | [ ] | ['Deficiency of UDPglucose-hexose- 1-phosphate uridylyltransferase'] |
| NM_000039.1(APOA1):<br>c.220T > C<br>(p.Trp74Arg) | 121912726 | — | [ ] | [ ] | ['Familial visceral amyloidosis, Ostertag type'] |
| NM_000155.3(GALT):<br>c.677T > C<br>(p.Leu226Pro) | 111033752 | GALT | [ ] | ['CAGGAGCYACT CAGGAAGGTGGG'] | ['Deficiency of UDPglucose-hexose-1-phosphate uridylyltransferase'] |
| NM_000039.1(APOA1):<br>c.593T > C<br>(p.Leu198Ser) | 121912729 | APOA1 | [ ] | ['GCGCTYGGCCGC GCGCCTTGAGG'] | ['Familial visceral amyloidosis, Ostertag type'] |
| NM_000155.3(GALT):<br>c.745T > C<br>(p.Trp249Arg) | 111033757 | GALT | [ ] | [ ] | ['Deficiency of UDPglucose-hexose-1-phosphate uridylyltransferase'] |
| NM_001681.3(ATP2A2):<br>c.1678T > C<br>(p.Cys560Arg) | 121912734 | ATP2A2 | [ ] | [ ] | ['Keratosis follicularis'] |
| NM_000041.3(APOE):<br>c.137T > C<br>(p.Leu46Pro) | 769452 | APOE | [ ] | ['AACYGGCACTG GGTCGCTTTTGG'] | [ ] |
| NM_000342.3(SLC4A1):<br>c.2317T > C<br>(p.Ser773Pro) | 121912753 | SLC4A1 | [ ] | [ ] | ['Renal tubular acidosis, distal, with normal red cell morphology'] |
| NM_003002.3(SDHD):<br>c.284T > C<br>(p.Leu95Pro) | 80338846 | SDHD | [ ] | [ ] | ['Hereditary Paraglioma-Pheochromocytoma Syndromes'] |
| NM_016124.4(RHD):<br>c.329T > C<br>(p.Leu110Pro) | 121912762 | RHD | [ ] | ['ACACYGTTCAGG TATTGGGATGG'] | [ ] |
| NM_003002.3(SDHD):<br>c.416T > C<br>(p.Leu139Pro) | 80338847 | SDHD | [ ] | [ ] | ['Hereditary Paraglioma-Pheochromocytoma Syndromes', 'Paragliomas 1'] |
| NM_001822.5(CHN1):<br>c.427T > C<br>(p.Tyr143His) | 121912794 | CHN1 | [ ] | [ ] | ['Duane syndrome type 2'] |
| NM_000155.3(GALT):<br>c.1138T > C<br>(p.Ter380Arg) | 111033824 | GALT | [ ] | [CGCCYGACCAC GCCGACCACAGG', 'GCCYGACCACGC CGACCACAGG'] | ['Deficiency of UDPglucose-hexose-1-phosphate uridylyltransferase'] |
| m.3271T > C | 199474658 | MT-TL1 | [ ] | [ ] | ['Juvenile myopathy, encephalopathy, lactic acidosis AND stroke'] |
| NM_000155.3(GALT):<br>c.980T > C<br>(p.Leu327Pro) | 111033832 | GALT | [ ] | ['TCCYGCGCTCTG CCACTGTCCGG'] | ['Deficiency of UDPglucose-hexose-1-phosphate uridylyltransferase'] |
| m.3290T > C | 199474665 | MT-TL1 | [ ] | [ ] | ['Sudden infant death syndrome'] |
| NM_020549.4(CHAT):<br>c.629T > C<br>(p.Leu210Pro) | 121912820 | CHAT | [ ] | [ ] | ['Familial infantile myasthenia'] |
| NM_020549.4(CHAT):<br>c.1007T > C<br>(p.Ile336Thr) | 121912823 | CHAT | [ ] | [ ] | ['Familial infantile myasthenia'] |
| NM_000155.3(GALT):<br>c.328 + 2T > C | 111033849 | GALT | [ ] | [ ] | ['Deficiency of UDPglucose- |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | | | hexose-1-phosphate uridylyltransferase'] |
| NM_000267.3(NF1): c.1595T > C (p.Leu532Pro) | 199474737 | NF1 | [ ] | [ ] | ['Neurofibromatosis, type 1', 'not provided'] |
| NM_000455.4(STK11): c.545T > C (p.Leu182Pro) | 730881974 | STK11 | [ ] | ['GGGAACCYGCT GCTCACCACCGG', 'AACCYGCTGCTC ACCACCGGTGG'] | ['Hereditary cancer-predisposing syndrome'] |
| NM_001042492.2(NF1): c.2288T > C (p.Leu763Pro) | 199474762 | NF1 | [ ] | [ ] | ['Hereditary cancer-predisposing syndrome', 'not provided'] |
| NM_001042492.2(NF1): c.5858T > C (p.Leu1953Pro) | 199474792 | NF1 | [ ] | [ ] | ['Neurofibromatosis, type 1', 'not provided'] |
| m.7512T > C | 199474817 | MT-TS1 | [ ] | [ ] | ['MERRF/MELAS overlap syndrome'] |
| m.7510T > C | 199474820 | MT-TS1 | [ ] | [ ] | ['Deafness, nonsyndromic sensorineural, mitochondrial'] |
| m.7511T > C | 199474821 | MT-TS1 | [ ] | [ ] | ['Deafness, nonsyndromic sensorineural, mitochondrial'] |
| m.2991T > C | 199474823 | MT-RNR2 | [ ] | [ ] | ['Chloramphenicol resistance'] |
| NM_201253.2(CRB1): c.3122T > C (p.Met1041Thr) | 62635656 | CRB1 | [ ] | [ ] | ['Retinitis pigmentosa 12', 'not provided'] |
| m.7587T > C | 199474825 | MT-OO2 | [ ] | [ ] | ['Cytochrome-c oxidase deficiency'] |
| NM_000400.3(ERCC2): c.1454T > C (p.Leu485Pro) | 121913025 | ERCC2 | [ ] | [ ] | ['Xeroderma pigmentosum, group D'] |
| NM_000157.3(GBA): c.703T > C (p.Ser235Pro) | 1064644 | GBA | [ ] | ['GGGYCACTCAA GGGACAGCCCGG'] | ['Gaucher disease'] |
| NM_001113755.2(TYMP): c.854T > C (p.Leu285Pro) | 121913042 | TYMP | [ ] | [ ] | [ ] |
| NM_000122.1(ERCC3): c.296T > C (p.Phe99Ser) | 121913045 | ERCC3 | [ ] | [ ] | ['Xeroderma pigmentosum, complementation group b'] |
| NM_000186.3(CFH): c.1606T > C (p.Cys536Arg) | 121913052 | CFH | [ ] | [ ] | ['Factor H deficiency'] |
| NM_138413.3(HOGA1): c.533T > C (p.Leu178Pro) | 796052090 | HOGA1 | [ ] | ['GGACCYGCCTGT GGATGCAGTGG'] | ['Primary hyperoxaluria, type III'] |
| NM_004370.5(COL12A1): c.7001T > C (p.Ile2334Thr) | 796052093 | COL12A1 | [ ] | [ ] | ['BETHLEM MYOPATHY 2'] |
| NM_000043.4(FAS): c.532T > C (p.Cys178Arg) | 121913084 | FAS | [ ] | [ ] | [ ] |
| NM_000208.2(INSR): c.779T > C (p.Leu260Pro) | 121913141 | INSR | [ ] | [CTACCYGGACG GCAGGTGTGTGG] | ['Leprechaunism syndrome'] |
| NM_000208.2(INSR): c.164T > C (p.Val55Ala) | 121913152 | INSR | [ ] | [ ] | ['Leprechaunism syndrome'] |
| NM_000026.2(ADSL): c.340T > C (p.Tyr114His) | 374259530 | ADSL | [ ] | [ ] | ['Adenylosuccinate lyase deficiency', 'not provided'] |
| NM_153490.2(KRT13): c.356T > C (p.Leu119Pro) | 60440396 | KRT13 | [ ] | [ ] | ['White sponge nevus 2', 'not provided'] |
| NM_022455.4(NSD1): c.5885T > C (p.Ile1962Thr) | 587784162 | NSD1 | [ ] | [ ] | ['Sotos syndrome 1'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006218.2(PIK3CA): c.1258T > C (p.Cys420Arg) | 121913272 | PIK3CA | [ ] | ['GGAACACYGTC CATTGGCATGGG', 'GAACACYGTCCA TTGGCATGGGG'] | ['Congenital lipomatous overgrowth, vascular malformations, and epidermal nevi', 'Neoplasm of ovary', 'PIK3CA Related Overgrowth Spectrum'] |
| NM_000552.3(VWF): c.8317T > C (p.Cys2773Arg) | 61751310 | VWF | [ ] | ['GCTCCYGCTGCT CTCCGACACGG'] | ['von Willebrand disease, type 2a', 'not provided'] |
| NM_000335.4(SCN5A): c.5504T > C (p.Ile1835Thr) | 45563942 | SCN5A | [ ] | [ ] | ['Primary dilated cardiomyopathy', 'Dilated cardiomyopathy 1E', 'not provided'] |
| NM_183415.2(UBE3B): c.1741 + 2T > C | 398123020 | UBE3B | [ ] | [ ] | ['Kaufman oculocerebrofacial syndrome'] |
| NM_000021.3(PSEN1): c.1175T > C (p.Leu392Pro) | 63750218 | PSEN1 | [ ] | [ ] | ['Alzheimer disease, type 3', 'not provided'] |
| NM_000350.2(ABCA4): c.1622T > C (p.Leu541Pro) | 61751392 | ABCA4 | [ ] | [ ] | ['Stargardt disease 1', 'Cone-rod dystrophy 3', 'not provided'] |
| NM_007313.2(ABL1): c.1109T > C (p.Met370Thr) | 121913457 | ABL1 | [ ] | [ ] | [ ] |
| NM_024408.3(NOTCH2): c.1117T > C (p.Cys373Arg) | 312262793 | NOTCH2 | [ ] | [ ] | ['Alagille syndrome 2'] |
| NM_024408.3(NOTCH2): c.1438T > C (p.Cys480Arg) | 312262799 | NOTCH2 | [ ] | ['TTCACAYGTCTG TGCATGCCAGG'] | ['Alagille syndrome 2'] |
| NM_003611.2(OFD1): c.111 + 2T > C | 312262809 | OFD1 | [ ] | [ ] | ['Oral-facial-digital syndrome', 'not provided'] |
| NM_003611.2(OFD1): c.274T > C (p.Ser92Pro) | 312262819 | OFD1 | [ ] | [ ] | ['Oral-facial-digital syndrome'] |
| NM_020631.4(PLEKHG5): c.1940T > C (p.Phe647Ser) | 63750315 | PLEKHG5 | [ ] | [ ] | ['Distal spinal muscular atrophy, autosomal recessive 4'] |
| NM_001288953.1(TTC7A): c.1912T > C (p.Ser638Pro) | 149602485 | TTC7A | [ ] | [ ] | ['Multiple gastrointestinal atresias'] |
| NM_000391.3(TPP1): c.1093T > C (p.Cys365Arg) | 119455953 | TPP1 | ['GCCG GGYGT TGGTC TGTCT CTGG'] | ['GCCGGGYGTTG GTCTGTCTCTGG'] | ['Ceroid lipofuscinosis, neuronal, 2', 'not provided'] |
| NM_000426.3(LAMA2): c.7691T > C (p.Leu2564Pro) | 121913570 | LAMA2 | [ ] | ['ATCATTCYTTTG GGAAGTGGAGG', 'TCATTCYTTTGGG AAGTGGAGGG'] | ['Merosin deficient congenital muscular dystrophy'] |
| NM_000426.3(LAMA2): c.2584T > C (p.Cys862Arg) | 121913573 | LAMA2 | [ ] | [ ] | ['Congenital muscular dystrophy due to partial LAMA2 deficiency'] |
| NM_000530.6(MPZ): c.404T > C (p.Ile135Thr) | 121913587 | MPZ | [ ] | [ ] | ['Charcot-Marie-Tooth disease type 1B'] |
| NM_201253.2(CRB1): c.3541T > C (p.Cys1181Arg) | 62636291 | CRB1 | [ ] | [ ] | ['Retinitis pigmentosa 12', 'not provided'] |
| NM_000257.3(MYH7): c.1046T > C (p.Met349Thr) | 121913640 | MYH7 | [ ] | ['AACTCCAYGTAT AAGCTGACAGG'] | ['Familial hypertrophic cardiomyopathy 1', 'Cardiomyopathy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000257.3(MYH7): c.1594T > C (p.Ser532Pro) | 121913642 | MYH7 | [ ] | ['CATCATGYCCAT CCTGGAAGAGG'] | ['Dilated cardiomyopathy 1S'] |
| NM_000257.3(MYH7): c.5378T > C (p.Leu1793Pro) | 121913654 | MYH7 | [ ] | [ ] | ['Familial hypertrophic cardiomyopathy 1', 'Myosin storage myopathy', 'Left ventricular noncompaction 5', 'Cardiomyopathy'] |
| NM_001127500.1(MET): c.3446T > C (p.Met1149Thr) | 121913668 | MET | [ ] | [ ] | ['Renal cell carcinoma, papillary, 1'] |
| NM_002443.3(MSMB): c.-89T= | 10993994 | MSMB | [ ] | [ ] | ['Prostate cancer, hereditary, 13'] |
| NM_001079802.1(FKTN): c.527T > C (p.Phe176Ser) | 119463996 | FKTN | [ ] | ['GTAGTCTYTCAT GAGAGGAGTGG'] | ['Limb-girdle muscular dystrophy-dystroglycanopathy, type C4'] |
| NM_000169.2(GLA): c.865A > T (p.Ile289Phe) | 140329381 | — | [ ] | [ ] | ['Fabry disease'] |
| NM_000420.2(KEL): c.1790T > C (p.Leu597Pro) | 8176038 | KEL | [ ] | [ ] | [ ] |
| NM_003999.2(OSMR): c.2072T > C (p.Ile691Thr) | 63750567 | OSMR | [ ] | [ ] | ['Primary localized cutaneous amyloidosis 1'] |
| NC_012920.1:m.9478 T > C | 587776437 | MT-003 | ['TCAG AAGYT TTTTTC TTCGC AGG'] | ['TCAGAAGYTTTT TTCTTCGCAGG'] | ['Leigh disease'] |
| NM_002775.4(HTRA1): c.1091T > C (p.Leu364Pro) | 587776447 | HTRA1 | [ ] | [ ] | ['Cerebral autosomal recessive arteriopathy with subcortical infarcts and leukoencephalopath 3'] |
| NM_002049.3(GATA1): c.2T > C (p.Met1Thr) | 587776451 | GATA1 | ['TCCA YGGAG TTCCCT GGCCT GGG', 'CCAYG GAGTT CCCTG GCCTG GGG'] | ['CTCCAYGGAGTT CCCTGGCCTGG', 'TCCAYGGAGTTC CCTGGCCTGGG', 'CCAYGGAGTTCC CTGGCCTGGGG'] | ['GATA-1-related thrombocytopenia with dyserythropoiesis'] |
| NM_000021.3(PSEN1): c.254T > C (p.Leu85Pro) | 63750599 | PSEN1 | [ ] | [ ] | ['Alzheimer disease, familial, 3, with spastic paraparesis and apraxia', 'not provided'] |
| NM_002049.3(GATA1): c.1240T > C (p.Ter414Arg) | 587776456 | GATA1 | [ ] | ['GCTCAYGAGGG CACAGAGCATGG'] | ['GATA-1-related thrombocytopenia with dyserythropoiesis'] |
| NM_006158.4(NEFL): c.281T > C (p.Leu94Pro) | 62636505 | NEFL | [ ] | [ ] | ['Charcot-Marie-Tooth disease type 2E', 'not provided'] |
| NM_000184.2(HBG2): c.-228T > C locus 1'] | 63750654 | HBG2 | [ ] | ['ATGCAAAYATCT GTCTGAAACGG'] | ['Fetal hemoglobin quantitative trait |
| NM_000353.2(TAT): c.236-5A > G | 587776512 | TAT | [ ] | [ ] | ['Tyrosinemia type 2'] |
| NM_173560.3(RFX6): c.380 + 2T > C | 587776514 | RFX6 | ['CAGT GGYGA GACTC GCCCG CAGG', 'AGTGG | ['CAGTGGYGAGA CTCGCCCGCAGG', 'AGTGGYGAGACT CGCCCGCAGGG'] | ['Mitchell-Riley syndrome'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | YGAGA CTCGC CCGCA GGG'] | | |
| NM_001999.3(FBN2): c.3725-15A > G | 587776519 | FBN2 | [ ] | ['AGCAYTGCAAC CACATTGTCAGG'] | ['Congenital contractural arachnodactyly'] |
| NM_000404.2(GLB1): c.1480-2A > G | 587776526 | GLB1 | [ ] | [ ] | ['GM1-GANGLIOSIDOSIS, TYPE I, WITH CARDIAC INVOLVEMENT'] |
| NM_000402.4(G6PD): c.473T > C (p.Leu158Pro) | 78365220 | G6PD | [ ] | ['TGCCCYCCACCT GGGGTCACAGG'] | ['Anemia, nonspherocytic hemolytic, due to G6PD deficiency', 'not provided'] |
| NM_000179.2(MSH6): c.1346T > C (p.Leu449Pro) | 63750741 | MSH6 | [ ] | ['CTGGGGCYGGT ATTCATGAAAGG'] | ['Hereditary Nonpolyposis Colorectal Neoplasms'] |
| NM_145046.4(CALR3): c.245A > G (p.Lys82Arg) | 142951029 | CALR3 | ['CGGT YTGAA GCGTG CAGAG ATGG'] | ['CGGTYTGAAGC GTGCAGAGATGG'] | ['Arrhythmogenic right ventricular cardiomyopathy', 'Familial hypertrophic cardiomyopathy 19', 'Hypertrophic cardiomyopathy'] |
| NM_000260.3(MY07A): c.5573T > C (p.Leu1858Pro) | 368657015 | MY07A | [ ] | [ ] | ['Usher syndrome, type 1'] |
| NM_024753.4(TTC21B): c.2758-2A > G | 766132877 | TTC21B | [ ] | [ ] | ['Nephronophthisis 12'] |
| NM_001195129.1(PRSS56): c.1183T > C (p.Cys395Arg) | 730882161 | PRSS56 | [ ] | [ ] | ['Microphthalmia, isolated 6'] |
| NM_001184.3(ATR): c.2022A > G (p.Gly674=) | 587776690 | ATR | [ ] | [ ] | ['Seckel syndrome 1'] |
| NM_000354.5(SERPINA7): c.623-2A > G | 587776720 | SERPINA7 | [ ] | [ ] | [ ] |
| NM_000133.3(F9):c.2 77 + 2T > C | 587776735 | F9 | [ ] | [ ] | ['Hereditary factor IX deficiency disease'] |
| NM_004006.2(DMD): c.9225-285A > G | 587776747 | DMD | [ ] | [ ] | ['Becker muscular dystrophy'] |
| NM_016835.4(MAPT): c.1839T > C (p.Asn613=) | 63750912 | MAPT | ['GGAT AAYAT CAAAC ACGTC CCGG', 'GATAA YATCA AACAC GTCCC GGG'] | ['GGATAAYATCA AACACGTCCCGG', 'GATAAYATCAAA CACGTCCCGGG'] | ['Frontotemporal dementia', 'not provided'] |
| NM_000321.2(RB1): c.1960 + 2T > C | 587776780 | RB1 | [ ] | [ ] | ['Retinoblastoma'] |
| NM_006517.4(SLC16A2): c.1253T > C (p.Leu418Pro) | 367543059 | SLC16A2 | [ ] | [ ] | ['Allan-Herndon-Dudley syndrome'] |
| NM_000421.3(KRT10): c.1374-2A > G | 587776815 | — | [ ] | [ ] | ['Erythroderma, ichthyosiform, congenital reticular'] |
| NM_000251.2(MSH2): c.2089T > C (p.Cys697Arg) | 63750961 | MSH2 | [ ] | [ ] | ['Hereditary Nonpolyposis Colorectal Neoplasms'] |
| NM_002618.3(PEX13): c.977T > C (p.Ile326Thr) | 61752115 | PEX13 | [ ] | [ ] | ['Peroxisome biogenesis disorder 11B'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001079867.1(PEX2): c.739T > C (p.Cys247Arg) | 61752128 | PEX2 | [ ] | [ ] | ['Peroxisome biogenesis disorder 5A'] |
| NM_017929.5(PEX26): c.134T > C (p.Leu45Pro) | 61752132 | PEX26 | [ ] | [ ] | ['Peroxisome biogenesis disorder 7B'] |
| NG_012088.1:g.2209 A > G | 587776843 | IL10 | ['ACCYTATGATCCGCCCGCCTTGG'] | ['ACCYTATGATCCGCCCGCCTTGG'] | [ ] |
| NM_001735.2(C5): c.1115A > G (p.Lys372Arg) | 587776846 | C5 | [ ] | [ ] | ['Leiner disease'] |
| NM_002087.3(GRN): c.2T > C (p.Met1Thr) | 63751006 | GRN | ['CCAYGTGGACCCTGGTGAGCTGG'] | ['CCAYGTGGACCCTGGTGAGCTGG'] | ['Frontotemporal dementia, ubiquitin-positive', 'not provided'] |
| NM_004656.3(BAP1): c.2057-2A > G | 587776878 | BAP1 | [ ] | [ ] | ['Tumor predisposition syndrome'] |
| NM_004656.3(BAP1): c.438-2A > G | 587776879 | BAP1 | ['GCCYGGGGAAAACAGAGTCAGG'] | ['GCCYGGGGAAAACAGAGTCAGG'] | ['Tumor predisposition syndrome'] |
| NM_004329.2(BMPR1A): c.370T > C (p.Cys124Arg) | 199476087 | BMPR1A | [ ] | [ ] | ['Juvenile polyposis syndrome', 'Hereditary cancer-predisposing syndrome'] |
| NM_000510.2(FSHB): c.298T > C (p.Cys100Arg) | 5030777 | FSHB | [ ] | [ ] | ['Follicle-stimulating hormone deficiency, isolated'] |
| NM_001009944.2(PKD1): c.2534T > C (p.Leu845Ser) | 199476100 | PKD1 | [ ] | [ ] | ['Polycystic kidney disease, adult type'] |
| NM_004963.3(GUCY2C): c.1160A > G (p.Asp387Gly) | 587776905 | GUCY2C | [ ] | [ ] | ['Meconium ileus'] |
| m.14487T > C | 199476109 | MT-ND6 | [ ] | [ ] | ['Leigh disease', 'Leigh syndrome due to mitochondrial complex I deficiency'] |
| NM_017565.3(FAM20A): c.813-2A > G | 587776912 | — | [ ] | [ ] | ['Enamel-renal syndrome'] |
| NM_017565.3(FAM20A): c.590-2A > G | 587776914 | FAM20A | [ ] | ['GTAATCYGCAAAGGAGGAGAAGG', 'TAATCYGCAAAGGAGGAGAAGGG'] | ['Enamel-renal syndrome'] |
| NM_014165.3(NDUFAF4): c.194T > C (p.Leu65Pro) | 63751061 | NDUFAF4 | [ ] | [ ] | ['Mitochondrial complex I deficiency'] |
| m.4160T > C | 199476119 | MT-ND1 | [ ] | [ ] | ['Leber optic atrophy'] |
| NM_000551.3(VHL): c.292T > C (p.Tyr98His) | 5030809 | VHL | [ ] | ['CCCYACCCAACGCTGCCGCCTGG'] | ['Von Hippel-Lindau syndrome', 'Hereditary cancer-predisposing syndrome'] |
| m.3949T > C | 199476124 | MT-ND1 | [ ] | [ ] | ['Juvenile myopathy, encephalopathy, lactic acidosis AND stroke'] |
| m.6742T > C | 199476126 | MT-CO1 | [ ] | [ ] | [ ] |
| m.6721T > C | 199476127 | MT-CO1 | [ ] | [ ] | [ ] |
| m.5692T > C | 199476131 | MT-TN | [ ] | [ ] | [ ] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| m.5728T > C | 199476132 | MT-TN | [ ] | ['CAATCYACTTCT CCCGCCGCCGG', 'AATCYACTTCTC CCGCCGCCGGG'] | ['Cytochrome-c oxidase deficiency', 'Mitochondrial complex ] deficiency'] |
| m.9101T > C | 199476134 | MT-ATP6 | [ ] | [ ] | ['Leber optic atrophy'] |
| m.8851T > C | 199476136 | MT-ATP6 | [ ] | [ ] | ['Leigh disease', 'Striatonigral degeneration, infantile, mitochondrial'] |
| m.9185T > C | 199476138 | MT-ATP6 | [ ] | [ ] | ['Leigh disease'] |
| NM_000277.1(PAH): c.143T > C (p.Leu48Ser) | 5030841 | PAH | [ ] | [ ] | ['Phenylketonuria', 'not provided'] |
| NM_000277.1(PAH): c.691T > C (p.Ser231Pro) | 5030845 | PAH | [ ] | [ ] | ['Phenylketonuria', 'not provided'] |
| NM_000251.2(MSH2): c.595T > C (p.Cys199Arg) | 63751110 | MSH2 | ['AAGG AAYGT GTTTT ACCCG GAGG'] | ['AAGGAAYGTGT TTTACCCGGAGG'] | ['Hereditary Nonpolyposis Colorectal Neoplasms'] |
| NM_000039.1(AP0A1): c.341T > C (p.Leu114Pro) | 28931575 | — | [ ] | [ ] | [ ] |
| NM_001288953.1(TTC7A): c.2366T > C (p.Leu789Pro) | 587776972 | TTC7A | [ ] | [ ] | ['Multiple gastrointestinal atresias'] |
| NM_014336.4(AIPL1): c.715T > C (p.Cys239Arg) | 62637012 | AIPL1 | [ ] | [CTGCCAGYGCCT GCTGAAGAAGG', 'CCAGYGCCTGCT GAAGAAGGAGG'] | ['Leber congenital amaurosis 4', 'not provided'] |
| NM_000155.3(GALT): c.336T > C (p.Ser112=) | 367543254 | GALT | [ ] | [ ] | ['Deficiency of UDPglucose-hexose-1-phosphate uridylyltransferase'] |
| NM_207352.3(CYP4V2): c.655T > C (p.Tyr219His) | 199476191 | CYP4V2 | [ ] | [ ] | ['Bietti crystalline corneoretinal dystrophy'] |
| NM_207352.3(CYP4V2): c.1021T > C (p.Ser341Pro) | 199476199 | CYP4V2 | [ ] | [AAACTGGYCCTT ATACCTGTTGG', 'AACTGGYCCTTA TACCTGTTGGG'] | ['Bietti crystalline corneoretinal dystrophy'] |
| NM_001142519.1(FAM111A): c.1531T > C (p.Tyr511His) | 587777012 | FAM111A | [ ] | [ ] | ['Kenny-Caffey syndrome type 2'] |
| NM_000435.2(NOTCH3): c.4556T > C (p.Leu1519Pro) | 367543285 | NOTCH3 | [ ] | [ ] | ['Infantile myofibromatosis 1', 'Infantile myofibromatosis 2'] |
| NM_000021.3(PSEN1): c.749T > C (p.Leu250Ser) | 63751163 | PSEN1 | [ ] | [ ] | ['Alzheimer disease, type 3', 'not provided'] |
| NM_001283009.1(RTEL1): c.3730T > C (p.Cys1244Arg) | 587777037 | — | ['CTGTG TGYGC CAGGG CTGTG GGG'] | ['CTGTGTGYGCCA GGGCTGTGGGG'] | ['Dyskeratosis congenita, autosomal recessive, 5'] |
| NM_001135021.1(ELMOD3): c.794T > C (p.Leu265Ser) | 587777040 | ELMOD3 | [ ] | [ ] | ['Deafness, autosomal recessive 88'] |
| NM_001001557.2(GDF6): c.866T > C (p.Leu289Pro) | 63751220 | GDF6 | [ ] | [ ] | ['Klippel-Feil syndrome 1, autosomal dominant'] |
| NM_014754.2(PTDSS1): c.794T > C (p.Leu265Pro) | 587777090 | PTDSS1 | [ ] | [ ] | [Lenz-Majewski hyperostosis syndrome'] |
| NM_052844.3(WDR34): c.1307A > G (p.Lys436Arg) | 587777098 | WDR34 | [ ] | [ ] | ['Short-rib thoracic dysplasia 11 with or without polydactyly'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001290048.1(ATL3): c.521A > G (p.Tyr174Cys) | 587777108 | ATL3 | [ ] | [ ] | ['Hereditary sensory neuropathy type IF'] |
| NM_001018005.1(TPM1): c.515T > C (p.Ile172Thr) | 199476312 | TPM1 | [ ] | [ ] | ['Primary familial hypertrophic cardiomyopathy', 'Cardiomyopathy', 'not provided'] |
| NM_018849.2(ABCB4): c.523A > G (p.Thr175Ala) | 58238559 | ABCB4 | [ ] | [ ] | ['Cholecystitis'] |
| NM_001018005.1(TPM1): c.842T > C (p.Met281Thr) | 199476321 | TPM1 | [ ] | [ ] | ['Cardiomyopathy', 'not specified', 'not provided'] |
| NM_005763.3(AASS): c.874A > G (p.Ile292Val) | 587777122 | AASS | [ ] | [ ] | ['Hyperlysinemia'] |
| NM_194442.2(LBR): c.1639A > G (p.Asn547Asp) | 587777171 | LBR | [ ] | [ ] | ['Greenberg dysplasia'] |
| NM_006702.4(PNPLA6): c.3053T > C (p.Phe1018Ser) | 587777183 | PNPLA6 | [ ] | ['CCTYTAACCGCA GCATCCATCGG'] | ['Boucher Neuhauser syndrome'] |
| NM_000487.5(ARSA) :c.899T > C (p.Leu300Ser) | 199476389 | ARSA | [ ] | ['GGTCTCTYGCGG TGTGGAAAGGG'] | ['Metachromatic leukodystrophy', 'not provided'] |
| NM_016599.4(MYOZ2): c.142T > C (p.Ser48Pro) | 199476398 | MYOZ2 | [ ] | ['TTAYCCCATCTC AGTAACCGTGG'] | ['Familial hypertrophic cardiomyopathy 16', 'not provided'] |
| NM_014740.3(EIF4A3): c.809A > G (p.Asp270Gly) | 587777204 | EIF4A3 | [ ] | [ ] | ['Richieri Costa Pereira syndrome'] |
| NM_001040436.2(YARS2): c.1303A > G (p.Ser435Gly) | 587777215 | YARS2 | [ ] | [ ] | ['Myopathy, lactic acidosis, and sideroblastic anemia 2'] |
| NM_001278503.1(STT3A): c.1877T > C (p.Val626Ala) | 587777216 | STT3A | [ ] | [ ] | ['Congenital disorder of glycosylation type 1w'] |
| NM_001037633.1(SIL1): c.1370T > C (p.Leu457Pro) | 119456967 | SIL1 | [ ] | ['TTGCYGAAGGA GCTGAGATGAGG'] | [Marinesco-Sj\xc3\xb6gren syndrome'] |
| NM_006888.4(CALM1): c.268T > C (p.Phe90Leu) | 730882253 | CALM1 | [ ] | ['GGCAYTCCGAGT CTTTGACAAGG'] | ['Long QT syndrome 14'] |
| NM_001003811.1(TEX11): c.511A > G (p.Met171Val) | 143246552 | TEX11 | ['TCCA YGGTC AAGTC AGCCT CAGG'] | ['TCCAYGGTCAAG TCAGCCTCAGG', 'CCAYGGTCAAGT CAGCCTCAGGG'] | ['Spermatogenic failure, X-linked, 2'] |
| NM_033419.4(PGAP3): c.914A > G (p.Asp305Gly) | 587777252 | PGAP3 | [ ] | [ ] | ['Hyperphosphatasia with mental retardation syndrome 4'] |
| NM_000021.3(PSEN1): c.338T > C (p.Leu113Pro) | 63751399 | PSEN1 | [ ] | [ ] | ['Alzheimer disease, type 3', 'Frontotemporal dementia', 'not provided'] |
| NM_000097.5(CPOX): c.980A > G (p.His327Arg) | 587777271 | CPOX | [ ] | [ ] | ['Harderoporphyria'] |
| NM_005654.5(NR2F1): c.755T > C (p.Leu252Pro) | 587777276 | NR2F1 | [ ] | [ ] | ['Bosch-boonstra-schaaf optic atrophy syndrome'] |
| NM_012338.3(TSPAN12): c.413A > G (p.Tyr138Cys) | 587777283 | TSPAN12 | [ ] | ['TAATCCAYAATT TGTCATCCTGG'] | ['Exudative vitreoretinopathy 5'] |
| NM_003181.3(T): c.512A > G (p.His171Arg) | 587777303 | T | [ ] | [ ] | ['Sacral agenesis with vertebral anomalies'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_015884.3(MBTPS2): c.1391T > C (p.Phe464Ser) | 587777306 | MBTPS2 | [ ] | ['GCTYTGCTTTGG ATGGACAATGG'] | ['Palmoplantar keratoderma, mutilating, with periorificial keratotic plaques, X-linked'] |
| NM_020435.3(GJC2): c.857T > C (p.Met286Thr) | 74315311 | GJC2 | ['TGAG AYGGC CCACC TGGGC TTGG'] | ['TGAGAYGGCCC ACCTGGGCTTGG', 'GAGAYGGCCCAC CTGGGCTTGGG'] | ['Leukodystrophy, hypomyelinating, 2'] |
| NM_005356.4(LCK): c.1022T > C (p.Leu341Pro) | 587777335 | LCK | [ ] | [ ] | ['Immunodeficiency 22'] |
| NM_005861.3(STUB1): c.719T > C (p.Met240Thr) | 587777345 | — | [ ] | [ ] | ['Spinocerebellar ataxia, autosomal recessive 16'] |
| NM_000250.1(MPO): c.752T > C (p.Met251Thr) | 56378716 | MPO | [ ] | ['TCACTCAYGTTC ATGCAATGGGG'] | ['Myeloperoxidase deficiency'] |
| NM_017890.4(VPS13B): c.11119 + 2T > C | 587777382 | VPS13B | [ ] | [ ] | ['Cohen syndrome'] |
| NM_005026.3(PIK3CD): c.1246T > C (p.Cys416Arg) | 587777390 | PIK3CD | [ ] | ['GCAGGACYGCC CCATTGCCTGGG'] | ['Activated PI3K-delta syndrome'] |
| NM_002633.2(PGM1): c.1547T > C (p.Leu516Pro) | 587777401 | PGM1 | [ ] | [ ] | ['Congenital disorder of glycosylation type it'] |
| NM_000261.1(MYOC): c.1309T > C (p.Tyr437His) | 74315328 | MYOC | [ ] | [ ] | ['Primary open angle glaucoma juvenile onset 1'] |
| NM_001159287.1(TPI1): c.833T > C (p.Phe278Ser) | 587777440 | TPI1 | [ ] | [ ] | ['Triosephosphate isomerase deficiency'] |
| NM_000414.3(HSD17B4): c.1547T > C (p.Ile516Thr) | 587777443 | HSD17B4 | [ ] | [ ] | ['Gonadal dysgenesis with auditory dysfunction, autosomal recessive inheritance'] |
| NM_005359.5(SMAD4): c.970T > C (p.Cys324Arg) | 377767339 | SMAD4 | [ ] | [ ] | ['Juvenile polyposis syndrome'] |
| NM_000211.4(ITGB2): c.1877 + 2T > C | 483352818 | ITGB2 | ['CATG YGAGT GCAGG CGGAG CAGG'] | ['CATGYGAGTGC AGGCGGAGCAGG'] | ['Leukocyte adhesion deficiency type 1'] |
| NM_005359.5(SMAD4): c.1087T > C (p.Cys363Arg) | 377767348 | SMAD4 | [ ] | [ ] | ['Juvenile polyposis syndrome'] |
| NM_001128159.2(VPS53): c.2084A > G (p.Gln695Arg) | 587777465 | VPS53 | [ ] | [ ] | ['Pontocerebellar hypoplasia, type 2e'] |
| NM_000249.3(MLH1): c.1745T > C (p.Leu582Pro) | 63751616 | MLH1 | [ ] | [ ] | ['Hereditary Nonpolyposis Colorectal Neoplasms'] |
| NM_003108.3(SOX11): c.178T > C (p.Ser60Pro) | 587777480 | SOX11 | [ ] | ['TATGGYCCAAG ATCGAACGCAGG'] | ['Mental retardation, autosomal dominant 27'] |
| NM_020630.4(RET): c.1888T > C (p.Cys630Arg) | 377767404 | RET | [ ] | [ ] | [ ] |
| NM_017565.3(FAM20A): c.720-2A > G | 587777530 | — | [ ] | [ ] | ['Enamel-renal syndrome'] |
| NM_015599.2(PGM3): c.737A > G (p.Asn246Ser) | 587777562 | PGM3 | ['TAAA TGAYT GAGTT TGCCC TTGG'] | ['TAAATGAYTGA GTTTGCCCTTGG'] | ['Immunodeficiency 23'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_015599.2(PGM3): c.1352A > G (p.Gln451Arg) | 587777565 | PGM3 | [ ] | [ ] | ['Immunodeficiency 23'] |
| NM_000206.2(IL2RG): c.452T > C (p.Leu151Pro) | 137852511 | IL2RG | [ ] | [ ] | ['X-linked severe combined immunodeficiency'] |
| NM_198282.3(TMEM173): c.461A > G (p.Asn154Ser) | 587777609 | TMEM173 | [ ] | [ ] | ['Sting-associated vasculopathy, infantile-onset'] |
| NM_000329.2(RPE65): c.1022T > C (p.Leu341Ser) | 61752909 | RPE65 | [ ] | [ ] | ['Retinitis pigmentosa 20', 'not provided'] |
| NM_001127899.3(CLCN5): c.1768T > C (p.Ser590Pro) | 151340623 | CLCN5 | [ ] | [ ] | ['Dent disease 1'] |
| NM_005027.3(PIK3R2): c.1202T > C (p.Leu401Pro) | 587777624 | PIK3R2 | [ ] | [ ] | ['Megalencephaly polymicrogyria-polydactyly hydrocephalus syndrome'] |
| NM_007315.3(STAT1): c.854A > G (p.Gln285Arg) | 587777629 | STAT1 | [ ] | [ ] | ['Immunodeficiency 31C'] |
| NM_139276.2(STAT3): c.1175A > G (p.Lys392Arg) | 587777648 | STAT3 | [ ] | [ ] | ['Autoimmune disease, multisystem, infantile-onset'] |
| NM_001037811.2(HSD17B10): c.257A > G (p.Asp86Gly) | 587777651 | HSD17B10 | [ ] | [ ] | [2-methyl-3-hydroxybutyric aciduria'] |
| NM_001288767.1(ARMC5): c.1928T > C (p.Leu643Pro) | 587777661 | ARMC5 | [ ] | [ ] | ['Acth-independent macronodular adrenal hyperplasia 2'] |
| NM_001288767.1(ARMC5): c.1379T > C (p.Leu460Pro) | 587777663 | ARMC5 | [ ] | ['GCCCGACYGCG GGATGCTGGTGG'] | ['Acth-independent macronodular adrenal hyperplasia 2'] |
| NM_007315.3(STAT1): c.2018A > G (p.Lys673Arg) | 587777704 | STAT1 | [ ] | [ ] | ['Immunodeficiency 31a'] |
| NM_007315.3(STAT1): c.1909A > G (p.Lys637Glu) | 587777705 | STAT1 | [ ] | [ ] | ['Immunodeficiency 31a'] |
| NM_014845.5(FIG4): c.50T > C (p.Leu17Pro) | 587777713 | FIG4 | [ ] | [ ] | ['Charcot-Marie-Tooth disease, type 4J'] |
| NM_000350.2(ABCA4): c.5819T > C (p.Leu1940Pro) | 61753033 | ABCA4 | [ ] | ['AAGGCYACATG AACTAACCAAGG'] | ['Stargardt disease', 'Stargardt disease 1', 'Cone-rod dystrophy 3', 'not provided'] |
| NM_002972.3(SBF1): c.4768A > G (p.Thr1590Ala) | 200488568 | SBF1 | [ ] | [CAGGCYCCTCT TGCTCAGCCGG'] | [Charcot-Marie-Tooth disease, type 4B3'] |
| NM_000377.2(WAS): c.244T > C (p.Ser82Pro) | 132630272 | WAS | [ ] | [ ] | [ ] |
| NM_000377.2(WAS): c.809T > C (p.Leu270Pro) | 132630274 | WAS | [ ] | ['CGGAGTCYGTTC TCCAGGGCAGG'] | ['Severe congenital neutropenia X-linked'] |
| NM_001128834.2(PLP1): c.487T > C (p.Trp163Arg) | 132630279 | PLP1 | [ ] | [ ] | ['Pelizaeus-Merzbacher disease', 'not provided'] |
| NM_001128834.2(PLP1): c.671T > C (p.Leu224Pro) | 132630283 | PLP1 | [ ] | [ ] | ['Pelizaeus-Merzbacher disease'] |
| NM_001128834.2(PLP1): c.560T > C (p.Ile187Thr) | 132630288 | PLP1 | [ ] | [ ] | ['Spastic paraplegia 2'] |
| NM_001128834.2(PLP1): c.710T > C (p.Phe237Ser) | 132630291 | PLP1 | [ ] | [ ] | ['Spastic paraplegia 2'] |
| NM_001015877.1(PHF6): c.2T > C | 132630300 | PHF6 | [ ] | [ ] | ['Borjeson-Forssman-Lehmann |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Met1Thr) | | | | | syndrome'] |
| NM_001399.4(EDA): c.181T > C (p.Tyr61His) | 132630308 | EDA | [ ] | ['CTGCYACCTAGA GTTGCGCTCGG'] | ['Hypohidrotic X-linked ectodermal dysplasia'] |
| NM_001205019.1(GK): c.1525T > C (p.Trp509Arg) | 132630330 | GK | [ ] | [ ] | ['Deficiency of glycerol kinase'] |
| NM_000076.2(CDKN1C): c.*5 + 2T > C | 587777866 | CDKN1C | ['CCAA GYGAG TACAG CGCAC CTGG', 'CAAGY GAGTA CAGCG CACCT GGG', 'AAGYG AGTAC AGCGC ACCTG GGG'] | ['CCAAGYGAGTA CAGCGCACCTGG', 'CAAGYGAGTACA GCGCACCTGGG', 'AAGYGAGTACAG CGCACCTGGGG'] | ['Beckwith-Wiedemann syndrome'] |
| NM_000271.4(NPC1): c.2054T > C (p.Ile685Thr) | 483352888 | NPC1 | [ ] | [ ] | ['Niemann-Pick disease type C1'] |
| NM_170707.3(LMNA): c.1589T > C (p.Leu530Pro) | 60934003 | LMNA | [ ] | [ACGGCTCYCATC AACTCCACTGG', 'CGGCTCYCATCA ACTCCACTGGG', 'GGCTCYCATCAA CTCCACTGGGG'] | ['Benign scapuloperoneal muscular dystrophy with cardiomyopathy', 'not provided'] |
| NM_001165963.1(SCN1A): c.5536A > T (p.Lys1846Ter) | 372098964 | — | [ ] | [ ] | ['Severe myoclonic epilepsy in infancy'] |
| NM_130838.1(UBE3A): c.2485T > C (p.Tyr829His) | 587784526 | UBE3A | [ ] | [ ] | ['Angelman syndrome'] |
| NM_014588.5(VSX1): c.50T > C (p.Leu17Pro) | 74315436 | VSX1 | [ ] | [ ] | ['Keratoconus 1'] |
| NM_000404.2(GLB1): c.457 + 2T > C | 398123354 | GLB1 | [ ] | [ ] | ['Mucopolysaccharid osis, MPS-IV-B', 'Infantile GM1 gangliosidosis', 'Juvenile GM > 1< gangliosidosis', 'Gangliosidosis GM1 type 3', 'not provided'] |
| NM_003159.2(CDKL5): c.145 + 2T > C | 267608430 | CDKL5 | [ ] | [ ] | ['Atypical Rett syndrome', 'not provided'] |
| NM_002764.3(PRPS1): c.869T > C (p.Ile290Thr) | 180177153 | PRPS1 | [ ] | [ ] | ['Deafness, high-frequency sensorineural, X-linked'] |
| NM_000030.2(AGXT): c.1076T > C (p.Leu359Pro) | 180177160 | AGXT | [ ] | ['GGTGCYGCGGA TCGGCCTGCTGG', 'GTGCYGCGGATC GGCCTGCTGGG'] | ['Primary hyperoxaluria, type I'] |
| NM_000030.2(AGXT): c.1151T > C (p.Leu384Pro) | 180177165 | AGXT | [ ] | [ ] | ['Primary hyperoxaluria, type I'] |
| NM_000030.2(AGXT): c.449T > C (p.Leu150Pro) | 180177222 | AGXT | [ ] | [GTGCYGCTGTTC TTAACCCACGG', 'TGCYGCTGTTCTT AACCCACGGG'] | ['Primary hyperoxaluria, type I'] |
| NM_000268.3(NF2): c.1079T > C (p.Leu360Pro) | 74315492 | NF2 | [ ] | [ ] | ['Neurofibromatosis, type 2'] |
| NM_000030.2(AGXT): c.661T > C (p.Ser221Pro) | 180177254 | AGXT | [ ] | ['GCTCATCYCCTT CAGTGACAAGG'] | ['Primary hyperoxaluria, type I'] |
| NM_000030.2(AGXT): | 180177264 | AGXT | [ ] | ['GGGGCYGTGAC | ['Primary |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.757T > C (p.Cys253Arg) | | | | GACCAGCCCAGG'] | hyperoxaluria, type I'] |
| NM_000030.2(AGXT): c.77T > C (p.Leu26Pro) | 180177268 | AGXT | [ ] | [ ] | ['Primary hyperoxaluria, type I'] |
| NM_000030.2(AGXT): c.851T > C (p.Leu284Pro) | 180177287 | AGXT | [ ] | [ ] | ['Primary hyperoxaluria, type I'] |
| NM_000030.2(AGXT): c.893T > C (p.Leu298Pro) | 180177293 | AGXT | [ ] | [GTATCYGCATGG GCGCCTGCAGG'] | ['Primary hyperoxaluria, type I'] |
| NM_012203.1(GRHPR): c.203T > C (p.Leu68Pro) | 180177305 | GRHPR | [ ] | [ ] | ['Primary hyperoxaluria, type II'] |
| NM_000017.3(ACADS): c.1057T > C (p.Ser353Pro) | 796051904 | ACADS | [ ] | [ ] | ['not provided'] |
| NM_000406.2(GNRHR): c.392T > C (p.Met131Thr) | 606231406 | GNRHR | [ ] | [ ] | ['Hypogonadotropic hypogonadism'] |
| NM_000255.3(MUT): c.842T > C (p.Leu281Ser) | 796052007 | MUT | [ ] | [ ] | ['not provided'] |
| NM_000030.2(AGXT): c.947T > C (p.Leu316Pro) | 796052063 | AGXT | [ ] | [ ] | ['Primary hyperoxaluria, type I'] |
| NM_138413.3(HOGA1): c.875T > C (p.Met292Thr) | 796052087 | HOGA1 | [ ] | [ ] | ['Primary hyperoxaluria, type III'] |
| NM_013382.5(POMT2): c.1997A > G (p.Tyr666Cys) | 200198778 | POMT2 | ['GGAA GYAGT GGTGG AAGTA GAGG'] | ['GGAAGYAGTGG TGGAAGTAGAGG'] | ['Congenital muscular dystrophy', 'Congenital muscular dystrophy-dystroglycanopathy with brain and eye anomalies, type A2', 'Muscular dystrophy', 'Congenital muscular dystrophy-dystroglycanopathy with mental retardation, type B2', 'not provided'] |
| NM_015909.3(NBAS): c.3164T > C (p.Leu1055Pro) | 796052121 | NBAS | [ ] | [ ] | ['Infantile liver failure syndrome 2'] |
| NM_000263.3(NAGLU): c.1208T > C (p.Ile403Thr) | 796052122 | NAGLU | [ ] | [ ] | ['Charcot-Marie-Tooth disease, axonal type 2V'] |
| NM_203290.2(POLR1C): c.436T > C (p.Cys146Arg) | 796052125 | POLR1C | [ ] | [ ] | ['LEUKODYSTROPHY, HYPOMYELINATING, 11'] |
| NM_018359.3(UFSP2): c.868T > C (p.Tyr290His) | 796052130 | — | [ ] | [ ] | ['Hip dysplasia, beukes type'] |
| NM_000053.3(ATP7B): c.122A > G (p.Asn41Ser) | 201738967 | ATP7B | [ ] | [ ] | ['Wilson disease'] |
| NM_001356.4(DDX3X): c.704T > C (p.Leu235Pro) | 796052224 | DDX3X | [ ] | [ ] | ['not provided'] |
| NM_001356.4(DDX3X): c.1541T > C (p.Ile514Thr) | 796052226 | DDX3X | [ ] | [ ] | ['not provided'] |
| NM_001356.4(DDX3X): c.1175T > C (p.Leu392Pro) | 796052232 | DDX3X | [ ] | [ ] | ['not provided'] |
| NM_000321.2(RB1): c.2663 + 2T > C | 587778839 | RB1 | [ ] | [ ] | ['Retinoblastoma'] |
| NM_000321.2(RB1): c.1472T > C (p.Leu491Pro) | 587778848 | RB1 | [ ] | [ ] | ['Retinoblastoma'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006894.5(FMO3): c.1079T > C (p.Leu360Pro) | 28363581 | FMO3 | [ ] | [ ] | ['Trimethylaminuria'] |
| NM_172107.2(KCNQ2): c.583T > C (p.Ser195Pro) | 796052620 | KCNQ2 | [ ] | [ ] | ['not provided'] |
| NM_001282227.1(CECR1): c.1232A > G (p.Tyr411Cys) | 376785840 | CECR1 | [ ] | ['GAAATCAYAGG ACAAGCCTTTGG'] | ['Polyarteritis nodosa'] |
| NM_170707.3(LMNA): c.644T > C (p.Leu215Pro) | 61295588 | LMNA | [ ] | [ ] | ['Dilated cardiomyopathy 1A', 'not provided'] |
| NM_005249.4(FOXG1): c.673T > C (p.Trp225Arg) | 796052482 | FOXG1 | [ ] | [ ] | ['not provided'] |
| NM_000806.5(GABRA1): c.788T > C (p.Met263Thr) | 796052491 | GABRA1 | [ ] | [ ] | ['not provided'] |
| NM_000251.2(MSH2): c.1319T > C (p.Leu440Pro) | 587779084 | MSH2 | [ ] | [ ] | ['Hereditary Nonpolyposis Colorectal Neoplasms'] |
| NM_003401.3(XRCC4): c.127T > C (p.Trp43Arg) | 587779351 | XRCC4 | [ ] | [ ] | ['Ateleiotic dwarfism'] |
| NM_198056.2(SCN5A): c.1247A > G (p.Tyr416Cys) | 372395294 | SCN5A | ['CTCA YAGGC CATTG CGACC ACGG'] | ['CTCAYAGGCCAT TGCGACCACGG'] | ['not provided'] |
| NM_000257.3(MYH7): c.4835T > C (p.Leu1612Pro) | 587779392 | — | [ ] | [ ] | ['Myopathy, distal, 1'] |
| NM_000257.3(MYH7): c.4937T > C (p.Leu1646Pro) | 587779393 | — | [ ] | ['GAGCCYCCAGA GCTTGTTGAAGG'] | ['Myopathy, distal, 1'] |
| NM_000404.2(GLB1): c.922T > C (p.Phe308Leu) | 587779404 | GLB1 | [ ] | [ ] | ['Infantile GM1 gangliosidosis'] |
| NM_012434.4(SLC17A5): c.500T > C (p.Leu167Pro) | 587779410 | SLC17A5 | [ ] | ['ATTGTACYCAGA GCACTAGAAGG'] | ['Sialic acid storage disease, severe infantile type'] |
| NM_000257.3(MYH7): c.4442T > C (p.Leu1481Pro) | 587779414 | — | [ ] | [ ] | ['Myopathy, distal, 1'] |
| NM_000090.3(COL3A1): c.2022 + 2T > C (p.Gly660_Lys674del) | 587779429 | COL3A1 | [ ] | [ ] | ['Ehlers-Danlos syndrome, type 4'] |
| NM_004453.3(ETFDH): c.1852T > C (p.Ter618Gln) | 765742496 | ETFDH | [ ] | [ ] | ['not provided'] |
| NM_000090.3(COL3A1): c.2337 + 2T > C (p.Gly762_Lys779del) | 587779513 | COL3A1 | [ ] | ['AGGYAACCCTTA ATACTACCTGG'] | ['Ehlers-Danlos syndrome, type 4'] |
| NM_000310.3(PPT1): c.2T > C (p.Met1Thr) | 796052927 | PPT1 | [ ] | [ ] | ['not provided'] |
| NM_020376.3(PNPLA2): c.757 + 2T > C | 777539013 | PNPLA2 | [ ] | ['GAACGGYGCGC GGACCCGGGCGG', 'AACGGYGCGCGG ACCCGGGCGGG'] | ['Neutral lipid storage disease with myopathy'] |
| NM_000090.3(COL3A1): c.3039 + 6T > C (p.Asp1013_Gly1014i nsVSSFYSTSQ) | 587779532 | COL3A1 | [ ] | [ ] | ['Ehlers-Danlos syndrome, type 4'] |
| NM_012452.2(TNFRSF13B): c.310T > C (p.Cys104Arg) | 34557412 | TNFRSF13B | [ ] | ['ACTTCYGTGAGA ACAAGCTCAGG'] | ['Immunoglobulin A deficiency 2', 'Common variable immunodeficiency 2'] |
| NM_000570.4(FCGR3B): c.244A= (p.Asn82=) | 147574249 | FCGR3B | [ ] | [ ] | [ ] |
| NM_001165963.1(SCN1A): | 796052970 | SCN1A | [ ] | ['CAAGCTYTGATA | ['not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.1094T > C (p.Phe365Ser) | | | | CCTTCAGTTGG', 'AAGCTYTGATAC CTTCAGTTGGG'] | |
| NC_012920.1:m.7505 T > C | 724159989 | MT-TS1 | [ ] | ['CCTCCAYGACTT TTTCAAAAAGG'] | ['Deafness, nonsyndromic sensorineural, mitochondrial'] |
| NM_000663.4(ABAT): c.1433T > C (p.Leu478Pro) | 724159991 | ABAT | [ ] | [ ] | ['Gamma-aminobutyric acid transaminase deficiency'] |
| NM_153818.1(PEX10): c.890T > C (p.Leu297Pro) | 724160000 | PEX10 | [ ] | [ ] | ['Peroxisome biogenesis disorder 6B'] |
| NM_153818.1(PEX10): c.2T > C (p.Met1Thr) | 724160002 | PEX10 | [ ] | [ ] | ['Peroxisome biogenesis disorder 6B'] |
| NM_000090.3(COL3A1): c.4399T > C (p.Ter1467Gln) | 587779618 | COL3A1 | [ ] | [ ] | ['Ehlers-Danlos syndrome, type 4'] |
| NM_002485.4(NBN): c.511A > G (p.Ile171Val) | 61754966 | NBN | [ ] | [ ] | ['Microcephaly, normal intelligence and immunodeficiency', 'Aplastic anemia', 'Hereditary cancer-predisposing syndrome', 'Leukemia, acute lymphoblastic, susceptibility to', 'not specified', 'not provided'] |
| NM_000090.3(COL3A1): c.2553 + 2T > C (p.Gly816_Ala851del) | 587779684 | COL3A1 | [ ] | [ ] | ['Ehlers-Danlos syndrome, type 4'] |
| NM_021007.2(SCN2A): c.4308 + 2T > C | 796053139 | SCN2A | ['CGAA ATGYA AGTCT AGTTA GAGG', 'GAAAT GYAAG TCTAG TTAGA GGG'] | ['CGAAATGYAAG TCTAGTTAGAGG', 'GAAATGYAAGTC TAGTTAGAGGG'] | ['not provided'] |
| NM_021007.2(SCN2A): c.4718T > C (p.Leu1573Pro) | 796053152 | SCN2A | [ ] | [ ] | ['not provided'] |
| NM_001101.3(ACTB): c.356T > C (p.Met119Thr) | 587779773 | ACTB | ['GAGA AGAYG ACCCA GGTGA GTGG'] | ['GAGAAGAYGAC CCAGGTGAGTGG'] | ['Baraitser-Winter syndrome 1'] |
| NM_021007.2(SCN2A): c.2306T > C (p.Ile769Thr) | 796053191 | SCN2A | [ ] | [ ] | ['not provided'] |
| NM_014191.3(SCN8A): c.4889T > C (p.Leu1630Pro) | 796053222 | SCN8A | [ ] | ['CGTCYGATCAAA GGCGCCAAAGG', 'GTCYGATCAAAG GCGCCAAAGGG'] | ['not provided'] |
| NM_012415.3(RAD54B): c.1778A > G (p.Asn593Ser) | 114216685 | RAD54B | [ ] | [ ] | ['Malignant lymphoma, non-Hodgkin'] |
| NM_007215.3(POLG2): c.1105A > G (p.Arg369Gly) | 201936720 | POLG2 | [ ] | [ ] | ['Autosomal dominant progressive external ophthalmoplegia with mitochondrial DNA deletions 4', 'not specified'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_004006.2(DMD): c.6982A > T (p.Lys2328Ter) | 754896795 | DMD | ['GCTTT TYTTC AAGCT GCCCA AGG'] | ['GCTTTTYTTCAA GCTGCCCAAGG'] | ['Duchenne muscular dystrophy', 'Becker muscular dystrophy', 'Dilated cardiomyopathy 3B'] |
| NM_001061.4(TBXAS1): c.248T > C (p.Leu83Pro) | 140005285 | TBXAS1 | [ ] | [ ] | ['not provided'] |
| NM_000540.2(RYR1): c.10817T > C (p.Leu3606Pro) | 118192127 | RYR1 | [ ] | ['TACTACCYGGAC CAGGTGGGTGG', 'ACTACCYGGACC AGGTGGGTGGG', 'CTACCYGGACCA GGTGGGTGGGG'] | ['Central core disease', 'not provided'] |
| NM_000138.4(FBN1): c.7754T > C (p.Ile2585Thr) | 727503054 | FBN1 | [ ] | [ ] | ['Thoracic aortic aneurysms and aortic dissections', 'Marfan syndrome'] |
| NM_001128227.2(GNE): c.2228T > C (p.Met743Thr) | 28937594 | GNE | [ ] | [ ] | ['Inclusion body myopathy 2', 'Nonaka myopathy'] |
| NM_000540.2(RYR1): c.14693T > C (p.Ile4898Thr) | 118192170 | RYR1 | [ ] | [AGGCAYTGGGG ACGAGATCGAGG] | ['Malignant hyperthermia susceptibility type 1', 'Central core disease', 'not provided'] |
| NM_005247.2(FGF3): c.466T > C (p.Ser156Pro) | 121917703 | FGF3 | [ ] | ['GTACGTGYCTGT GAACGGCAAGG', 'TACGTGYCTGTG AACGGCAAGGG'] | ['Deafness with labyrinthine aplasia microtia and microdontia (LAMM)'] |
| NM_005247.2(FGF3): c.17T > C (p.Leu6Pro) | 121917706 | FGF3 | [ ] | [ ] | ['Deafness with labyrinthine aplasia microtia and microdontia (LAMM)'] |
| NM_005211.3(CSF1R): c.2450T > C (p.Leu817Pro) | 690016549 | CSF1R | [ ] | ['CCGCCYGCCTGT GAAGTGGATGG'] | ['Hereditary diffuse leukoencephalopathy with spheroids'] |
| NM_005211.3(CSF1R): c.2480T > C (p.Ile827Thr) | 690016550 | CSF1R | [ ] | [ ] | ['Hereditary diffuse leukoencephalopathy with spheroids'] |
| NM_005211.3(CSF1R): c.2566T > C (p.Tyr856His) | 690016552 | CSF1R | [ ] | ['GAATCCCYACCC TGGCATCCTGG'] | ['Hereditary diffuse leukoencephalopathy with spheroids'] |
| NM_001098668.2(SFTPA2): c.593T > C (p.Phe198Ser) | 121917738 | SFTPA2 | [ ] | ['GGAGACTYCCG CTACTCAGATGG', 'GAGACTYCCGCT ACTCAGATGGM | ['Idiopathic fibrosing alveolitis, chronic form'] |
| NM_005211.3(CSF1R): c.1957T > C (p.Cys653Arg) | 690016559 | CSF1R | [ ] | ['AGCCYGTACCCA TGGAGGTAAGG', 'GCCYGTACCCAT GGAGGTAAGGG'] | ['Hereditary diffuse leukoencephalopathy with spheroids'] |
| NM_005211.3(CSF1R): c.2717T > C (p.Ile906Thr) | 690016560 | CSF1R | [ ] | ['GCAGAYCTGCTC CTTCCTTCAGG'] | ['Hereditary diffuse leukoencephalopathy with spheroids'] |
| NM_000540.2(RYR1): c.14378T > C (p.Leu4793Pro) | 118192179 | RYR1 | [ ] | [ ] | ['Central core disease', 'not provided'] |
| NM_199292.2(TH): c.707T > C (p.Leu236Pro) | 121917763 | TH | [ ] | [ ] | ['Segawa syndrome, autosomal recessive'] |
| NM_000256.3(MYBPC3): c.2994 + 2T > C | 727503176 | MYBPC3 | [ ] | [ ] | ['Familial hypertrophic cardiomyopathy 4'] |
| NM_003361.3(UMOD): c.376T > C (p.Cys126Arg) | 121917769 | UMOD | [ ] | ['GGCCACAYGTGT CAATGTGGTGG', 'GCCACAYGTGTC AATGTGGTGGG'] | ['Familial juvenile gout'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_003361.3(UMOD): c.943T > C (p.Cys315Arg) | 121917773 | UMOD | [ ] | ['ATGGCACYGCC AGTGCAAACAGG'] | ['Glomerulocystic kidney disease with hyperuricemia and isosthenuria'] |
| NM_024649.4(BBS1): c.1553T > C (p.Leu518Pro) | 121917778 | — | [ ] | [ ] | ['Bardet-Biedl syndrome 1'] |
| NM_172107.2(KCNQ2): c.2T > C (p.Met1Thr) | 118192186 | KCNQ2 | [ ] | [ ] | ['Benign familial neonatal seizures 1'] |
| NM_014324.5(AMACR): c.154T > C (p.Ser52Pro) | 121917814 | — | [ ] | [ ] | ['Alpha-methylacyl-CoA racemase deficiency', 'Bile acid synthesis defect, congenital, 4'] |
| NM_014324.5(AMACR): c.320T > C (p.Leu107Pro) | 121917816 | — | [ ] | [ ] | ['Bile acid synthesis defect, congenital, 4'] |
| NM_007255.2(B4GALT7): c.617T > C (p.Leu206Pro) | 121917818 | B4GALT7 | [ ] | ['TGCYCTCCAAGC AGCACTACCGG'] | ['Ehlers-Danlos syndrome progeroid type'] |
| NM_021615.4(CHST6): c.827T > C (p.Leu276Pro) | 121917824 | CHST6 | [ ] | ['GGACCYGGCGC GGGAGCCGCTGG'] | ['Macular corneal dystrophy Type I'] |
| NM_006261.4(PROP1): c.263T > C (p.Phe88Ser) | 121917841 | PROP1 | [ ] | [ ] | ['Pituitary hormone deficiency, combined 2'] |
| NM_000452.2(SLC10A2): c.728T > C (p.Leu243Pro) | 121917848 | SLC10A2 | [ ] | ['TTTCYTCTGGCT AGAATTGCTGG'] | ['Bile acid malabsorption, primary'] |
| NM_000322.4(PRPH2): c.637T > C (p.Cys213Arg) | 61755802 | PRPH2 | [ ] | [ ] | ['Patterned dystrophy of retinal pigment epithelium', 'not provided', 'Leber congenital amaurosis 18'] |
| NM_000517.4(HBA2): c.89T > C (p.Leu30Pro) | 41341344 | HBA2 | [ ] | [ ] | ['Hemoglobin H disease, nondeletional'] |
| NM_002181.3(IHH): c.569T > C (p.Val190Ala) | 121917857 | IHH | [ ] | [ ] | ['Acrocapitofemoral dysplasia'] |
| NM_000322.4(PRPH2): c.736T > C (p.Trp246Arg) | 61755817 | PRPH2 | ['ACCTGYGGGTGCGTGGCTGCAGG', 'CCTGYGGGTGCGTGGCTGCAGGG'] | ['ACCTGYGGGTGC GTGGCTGCAGG', 'CCTGYGGGTGCG TGGCTGCAGGG'] | ['Retinitis pigmentosa', 'not provided'] |
| NM_005413.3(SIX3): c.749T > C (p.Val250Ala) | 121917880 | SIX3 | [ ] | [ ] | ['Holoprosencephaly 2'] |
| NM_000124.3(ERCC6): c.2960T > C (p.Leu987Pro) | 121917905 | ERCC6 | ['TGCYAAAAGACCCAAAACAAGG'] | ['TGCYAAAAGAC CCAAAACAAGG'] | [Cerebro-oculo-facio-skeletal syndrome'] |
| NM_006920.4(SCN1A): c.4729T > C (p.Cys1577Arg) | 121917919 | — | [ ] | [ ] | ['Severe myoclonic epilepsy in infancy', 'not provided'] |
| NM_006920.4(SCN1A): c.5113T > C (p.Cys1705Arg) | 121917926 | — | [ ] | [ ] | ['Severe myoclonic epilepsy in infancy', 'not provided'] |
| NM_006920.4(SCN1A): c.3577T > C (p.Trp1193Arg) | 121917930 | — | ['AACAAYGGTGGAACCTGAGAAGG'] | ['AACAAYGGTGG AACCTGAGAAGG'] | ['Generalized epilepsy with febrile seizures plus, type 1', 'Generalized epilepsy with febrile seizures plus, type 2'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006920.4(SCN1A): c.838T > C (p.Trp280Arg) | 121917938 | SCN1A | [ ] | [ ] | ['Severe myoclonic epilepsy in infancy'] |
| NM_000478.4(ALPL): c.1306T > C (p.Tyr436His) | 121918006 | ALPL | [ ] | [IGGACYATGGTG AGACCTCCAGG] | ['Infantile hypophosphatasia'] |
| NM_000478.4(ALPL): c.979T > C (p.Phe327Leu) | 121918010 | ALPL | [ ] | [CAAAGGCYTCTT CTTGCTGGTGG', 'GGCYTCTTCTTGC TGGTGGAAGG'] | ['Infantile hypophosphatasia'] |
| NM_000301.3(PLG): c.1771T > C (p.5er591Pro) | 121918029 | PLG | [ ] | [ ] | ['Dysplasminogenemia'] |
| NM_000174.4(GP9): c.20T > C (p.Leu7Pro) | 121918038 | GP9 | [ ] | [ ] | ['Bernard-Soulier syndrome type C'] |
| NM_000371.3(TTR): c.224T > C (p.Leu75Pro) | 121918079 | TTR | [ ] | [ ] | ['Amyloidogenic transthyretin amyloidosis'] |
| NM_000371.3(TTR): c.88T > C (p.Cys30Arg) | 121918083 | TTR | [ ] | [ ] | ['Amyloidogenic transthyretin amyloidosis', 'Cardiomyopathy'] |
| NM_000371.3(TTR): c.272T > C (p.Val91Ala) | 121918084 | TTR | [ ] | [ ] | ['Amyloidogenic transthyretin amyloidosis'] |
| NM_000371.3(TTR): c.400T > C (p.Tyr134His) | 121918088 | TTR | [ ] | ['TCCCYACTCCTA TTCCACCACGG'] | [ ] |
| NM_012275.2(IL36RN):c.115 + 6T > C | 148755083 | IL36RN | [ ] | [ ] | ['Pustular psoriasis, generalized'] |
| NM_000371.3(TTR): c.95T > C (p.Leu32Pro) | 121918094 | TTR | [ ] | [ ] | ['Amyloidogenic transthyretin amyloidosis'] |
| NM_000371.3(TTR): c.265T > C (p.Tyr89His) | 121918100 | TTR | [ ] | [ ] | ['AMYLOIDOSIS, LEPTOMENINGEAL, TRANSTHYRETIN-RELATED'] |
| NM_001042465.1(PSAP): c.1055T > C (p.Leu352Pro) | 121918110 | PSAP | [ ] | ['GAAGCYGCCGA AGTCCCTGTCGG'] | ['Gaucher disease, atypical, due to saposin C deficiency'] |
| NM_013251.3(TAC3): c.269T > C (p.Met90Thr) | 121918123 | TAC3 | [ ] | [ ] | ['not provided'] |
| NM_199069.1(NDUFAF3): c.2T > C (p.Met1Thr) | 121918136 | NDUFAF3 | [ ] | [ ] | ['Mitochondrial complex I deficiency'] |
| NM_003730.4(RNASET2): c.550T > C (p.Cys184Arg) | 121918137 | RNASET2 | [ ] | [CCAGYGCCTTCC ACCAAGCCAGG] | ['Leukoencephalopathy, cystic, without megalencephaly'] |
| NM_203395.2(IYD): c.347T > C (p.Ile116Thr) | 121918139 | IYD | [ ] | [ ] | ['Iodotyrosine deiodination defect'] |
| NM_001127628.1(FBP1): c.581T > C (p.Phe194Ser) | 121918191 | FBP1 | [ ] | ['GGAGTYCATTTT GGTGGACAAGG'] | ['Fructose-biphosphatase deficiency'] |
| NM_015506.2(MMACHC): c.347T > C (p.Leu16Pro) | 121918240 | MMACHC | [ ] | [ ] | ['Methylmalonic acidemia with homocystinuria'] |
| NM_000255.3(MUT): c.313T > C (p.Trp105Arg) | 121918249 | MUT | [ ] | [ ] | ['METHYLMALONIC ACIDURIA, mut(0) TYPE'] |
| NM_022370.3(ROBO3): c.14T > C (p.Leu5Pro) | 121918275 | ROB03 | [ ] | [ ] | ['Gaze palsy, familial horizontal, with progressive scoliosis'] |
| NM_018400.3(SCN3B): c.29T > C (p.Leu10Pro) | 121918282 | SCN3B | [ ] | [ ] | ['Brugada syndrome', 'Brugada syndrome 7', 'Cardiac arrhythmia', 'Atrial fibrillation, familial, 16'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_004183.3(BEST1): c.122T > C (p.Leu41Pro) | 121918288 | BEST1 | [ ] | [ ] | ['Bestrophinopathy, autosomal recessive', 'not provided'] |
| NM_020166.4(MCCC1): c.640-2A > G | 772395858 | MCCC1 | [ ] | [ ] | ['3 Methylcrotonyl-CoA carboxylase 1 deficiency'] |
| NM_004817.3(TJP2): c.143T > C (p.Val48Ala) | 121918299 | TJP2 | [ ] | [ ] | ['Hypercholanemia, familial'] |
| NM_006946.2(SPTBN2): c.758T > C (p.Leu253Pro) | 121918306 | SPTBN2 | [ ] | ['ACCAAGCYGCT GGATCCCGAAGG', 'AAGCYGCTGGAT CCCGAAGGTGG', 'AGCYGCTGGATC CCGAAGGTGGG'] | ['Spinocerebellar ataxia 5'] |
| NM_000214.2(JAG1): c.110T > C (p.Leu37Ser) | 121918352 | JAG1 | [ ] | [ ] | ['Alagille syndrome 1'] |
| NM_007194.3(CHEK2): c.470T > C (p.Ile157Thr) | 17879961 | CHEK2 | [ ] | [ ] | ['Familial cancer of breast', 'Hereditary cancer-predisposing syndrome', 'Li-Fraumeni syndrome 2', 'not specified'] |
| NM_015384.4(NIPBL): c.7637T > C (p.Leu2546Pro) | 727503772 | NIPBL | [ ] | [ ] | ['Cornelia de Lange syndrome 1'] |
| NM_001083112.2(GPD2): c.1904T > C (p.Phe635Ser) | 121918407 | GPD2 | ['AAGT YTGAT GCAGA CCAGA AAGG'] | ['AAGTYTGATGCA GACCAGAAAGG'] | ['Diabetes mellitus type 2'] |
| NM_021957.3(GYS2): c.1447T > C (p.Ser483Pro) | 121918424 | GYS2 | [ ] | [ ] | ['Hypoglycemia with deficiency of glycogen synthetase in the liver'] |
| NM_018849.2(ABCB4): c.1207T > C (p.Tyr403His) | 121918443 | ABCB4 | [ ] | [ ] | ['Progressive familial intrahepatic cholestasis 3'] |
| NM_000212.2(ITGB3): c.2332T > C (p.Ser778Pro) | 121918447 | — | [ ] | [ ] | ['Glanzmann thrombasthenia'] |
| NM_000506.3(F2): c.1139T > C (p.Met380Thr) | 121918481 | F2 | [ ] | [ ] | ['Hereditary factor II deficiency disease'] |
| NM_000141.4(FGFR2): c.1018T > C (p.Tyr340His) | 121918489 | FGFR2 | ['TGGG GAAYA TACGT GCTTG GCGG', 'GGGGA AYATA CGTGC TTGGC GGG'] | ['TGGGGAAYATA CGTGCTTGGCGG', 'GGGGAAYATACG TGCTTGGCGGG'] | ['Crouzon syndrome'] |
| NM_000141.4(FGFR2): c.799T > C (p.Ser267Pro) | 121918505 | FGFR2 | [ ] | ['AATGCCYCCACA GTGGTCGGAGG'] | ['Pfeiffer syndrome', 'Neoplasm of stomach'] |
| NM_002739.3(PRKCG): c.355T > C (p.Ser119Pro) | 121918512 | PRKCG | [ ] | [ ] | ['Spinocerebellar ataxia 14'] |
| NM_002739.3(PRKCG): c.1927T > C (p.Phe643Leu) | 121918516 | PRKCG | [ ] | [ ] | ['Spinocerebellar ataxia 14'] |
| NM_015107.2(PHF8): c.836T > C (p.Phe279Ser) | 121918524 | PHF8 | [ ] | [ ] | [Siderius X-linked mental retardation syndrome'] |
| NM_000311.3(PRNP): c.593T > C (p.Phe198Ser) | 74315405 | PRNP | [ ] | [ ] | ['Gerstmann-Straussler-Scheinker syndrome', 'Genetic prion diseases'] |
| NM_015665.5(AAAS): c.787T > C (p.Ser263Pro) | 121918550 | AAAS | [ ] | [ ] | [Glucocorticoid deficiency with achalasia'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_003018.3(SFTPC): c.581T > C (p.Leu194Pro) | 121918560 | SFTPC | [ ] | [ ] | ['Surfactant metabolism dysfunction, pulmonary, 2'] |
| NM_000322.4(PRPH2): c.554T > C (p.Leu185Pro) | 121918563 | PRPH2 | [ ] | [ ] | ['Patterned dystrophy of retinal pigment epithelium', 'Retinitis pigmentosa 7, digenic', 'not provided', 'Leber congenital amaurosis 18] |
| NM_000322.4(PRPH2): c.2T > C (p.Met1Thr) | 121918565 | PRPH2 | [ ] | [ ] | ['Macular dystrophy, vitelliform, adult-onset', 'not provided'] |
| NM_001035.2(RYR2): c.1298T > C (p.Leu433Pro) | 121918602 | RYR2 | [ ] | [ ] | ['Arrhythmogenic right ventricular cardiomyopathy, type 2', 'Catecholaminergic polymorphic ventricular tachycardia', 'Long QT syndrome'] |
| NM_001199138.1(NLRC4): c.1022T > C (p.Val341Ala) | 587781260 | NLRC4 | [ ] | [ ] | ['Syndrome of enterolitis and autoinflmmation caused by mutation of NLRC4 (SCAN4)', 'Autoinflammation with infantile enterocolitis'] |
| NM_000702.3(ATP1A2): c.857T > C (p.Ile286Thr) | 121918617 | ATP1A2 | [ ] | [ ] | ['Familial hemiplegic migraine type 2'] |
| NM_006920.4(SCN1A): c.4250T > C (p.Val1417Ala) | 121918627 | — | [ ] | [ ] | ['Generalized epilepsy with febrile seizures plus, type 1', 'Generalized epilepsy with febrile seizures plus, type 2'] |
| NM_006920.4(SCN1A): c.434T > C (p.Met145Thr) | 121918631 | SCN1A | [ ] | [ ] | ['Generalized epilepsy with febrile seizures plus, type 2'] |
| NM_006920.4(SCN1A): c.4462T > C (p.Phe1488Leu) | 121918632 | — | [ ] | [ ] | ['Familial hemiplegic migraine type 3'] |
| NM_003126.2(SPTA1): c.781T > C (p.Ser261Pro) | 121918636 | SPTA1 | [ ] | [ ] | ['Elliptocytosis 2'] |
| NM_003126.2(SPTA1): c.620T > C (p.Leu207Pro) | 121918643 | SPTA1 | [ ] | ['GTGGAGCYGGT AGCTAAAGAAGG', 'TGGAGCYGGTAG CTAAAGAAGGG'] | ['Hereditary pyropoikilocytosis', 'Elliptocytosis 2'] |
| NM_001024858.2(SPTB): c.604T > C (p.Trp202Arg) | 121918646 | SPTB | [ ] | [CTCCAGCYGGA AGGATGGCTTGG'] | ['Spherocytosis type 2'] |
| NM_001024858.2(SPTB): c.6055T > C (p.Ser2019Pro) | 121918648 | SPTB | [ ] | ['ATGCCYCTGTGG CTGAGGCGTGG'] | [ ] |
| NM_001128177.1(THRB): c.929T > C (p.Met310Thr) | 121918699 | THRB | [ ] | [ ] | [ ] |
| NM_001128177.1(THRB): c.1373T > C (p.Val458Ala) | 121918704 | THRB | [ ] | [ ] | ['Thyroid hormone resistance, generalized, autosomal recessive'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000421.3(KRT10): c.482T > C (p.Leu161Ser) | 60118264 | — | [ ] | [ ] | ['Bullous ichthyosiform erythroderma', 'not provided'] |
| NM_006920.4(SCN1A): c.269T > C (p.Phe90Ser) | 121918733 | SCN1A | ['ACTTYTATAGTATTGAATAAAGG', 'CTTYTATAGTATTGAATAAAGGG'] | ['ACTTYTATAGTATTGAATAAAGG', 'CTTYTATAGTATTGAATAAAGGG'] | ['Severe myoclonic epilepsy in infancy'] |
| NM_006920.4(SCN1A): c.272T > C (p.Ile91Thr) | 121918734 | SCN1A | ['ACTTTAYAGTATTGAATAAAGG', 'CTTTTAYAGTATTGAATAAAGGG'] | ['ACTTTTAYAGTATTGAATAAAGG', 'CTTTTAYAGTATTGAATAAAGGAG'] | ['Severe myoclonic epilepsy in infancy'] |
| NM_006920.4(SCN1A): c.3827T > C (p.Leu1276Pro) | 121918740 | — | [ ] | [ ] | ['Severe myoclonic epilepsy in infancy'] |
| NM_000543.4(SMPD1): c.475T > C (p.Cys159Arg) | 727504166 | SMPD1 | [ ] | [IGAGGCCYGTGGCCTGCTCCTGG', 'GAGGCCYGTGGCCTGCTCCTGGG'] | ['Niemann-Pick disease, type A', 'Niemann-Pick disease, type B'] |
| NM_006920.4(SCN1A): c.568T > C (p.Trp190Arg) | 121918773 | SCN1A | [ ] | [ ] | ['Severe myoclonic epilepsy in infancy'] |
| NM_006920.4(SCN1A): c.5522T > C (p.Met1841Thr) | 121918783 | — | [ ] | [ ] | ['Severe myoclonic epilepsy in infancy', 'Generalized epilepsy with febrile seizures plus, type 1'] |
| NM_002538.3(0CLN): c.656T > C (p.Phe219Ser) | 267606926 | OCLN | [ ] | [ ] | ['Band-like calcification with simplified gyration and polymicrogyria'] |
| NM_000434.3(NEU1): c.1088T > C (p.Leu363Pro) | 193922915 | NEU1 | [ ] | [CAGCYATGGCCAGGCCCCAGTGG] | [Sialidosis, type II'] |
| NM_198578.3(LRRK2): c.6059T > C (p.Ile2020Thr) | 35870237 | LRRK2 | [ ] | [ ] | ['Parkinson disease 8, autosomal dominant'] |
| NM_000501.3(ELN): c.889 + 2T > C | 727504419 | ELN | [ ] | ['CAGGYAACATCTGTCCCAGCAGG', 'AGGYAACATCTGTCCCAGCAGGG'] | [Supravalvar aortic stenosis'] |
| NM_001085.4(SERPINA3): c.233T > C (p.Leu78Pro) | 1800463 | SERPINA3 | [ ] | [ ] | [ ] |
| NM_000238.3(KCNH2): c.1736T > C (p.Met579Thr) | 199473425 | KCNH2 | | | ['Congenital long QT syndrome'] |
| NM_001211.5(BUB1B): c.3035T > C (p.Leu1012Pro) | 28989185 | — | [ ] | [ ] | ['Mosaic variegated aneuploidy syndrome', 'Premature chromatid separation trait'] |
| NM_000256.3(MYBPC3): c.26-2A > G | 376395543 | MYBPC3 | [ ] | ['GAGACYGAAGGGCCAGGTGGAGG'] | ['Primary familial hypertrophic cardiomyopathy', 'Familial hypertrophic cardiomyopathy 4', 'Cardiomyopathy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000051.3(ATM):<br>c.4776 + 2T > C | 587781927 | ATM | [ ] | [ ] | ['Ataxia-telangiectasia syndrome', 'Hereditary cancer-predisposing syndrome'] |
| NM_006412.3(AGPAT2):<br>c.589-2A > G | 116807569 | AGPAT2 | [ ] | [ ] | ['Congenital generalized lipodystrophy type 1'] |
| NM_000545.6(HNF1A):<br>c.1720G > A<br>(p.Gly574Ser) | 1169305 | HNF1A | [ ] | ['GATGCYGGCAG GGTCCTGGCTGG', 'ATGCYGGCAGGG TCCTGGCTGGG', 'TGCYGGCAGGGT CCTGGCTGGGG'] | ['Maturity-onset diabetes of the young, type 3'] |
| NM_024514.4(CYP2R1):<br>c.296T > C<br>(p.Leu99Pro) | 61495246 | CYP2R1 | [ ] | [ ] | ['Vitamin d hydroxylation-deficient rickets, type 1b'] |
| NM_012213.2(MLYCD):<br>c.119T > C<br>(p.Met40Thr) | 28937908 | MLYCD | [ ] | [ ] | ['Deficiency of malonyl-CoA decarboxylase'] |
| NM_001101.3(ACTB):<br>c.224T > C<br>(p.Ile75Thr) | 587779771 | ACTB | [ ] | [ ] | ['Baraitser-Winter syndrome 1'] |
| NM_021007.2(SCN2A):<br>c.1271T > C<br>(p.Val424Ala) | 796053181 | SCN2A | ['TGTG GYGGC CATGG CCTAT GAGGl | ['TGTGGYGGCCAT GGCCTATGAGG'] | ['not provided'] |
| NM_002880.3(RAF1):<br>c.769T > C<br>(p.Ser257Pro) | 727505017 | RAF1 | [ ] | [ ] | ['Rasopathy', 'not specified'] |
| NM_000527.4(LDLR):<br>c.1468T > C<br>(p.Trp490Arg) | 730880130 | LDLR | [ ] | ['CTACYGGACCG ACTCTGTCCTGG', 'TACYGGACCGAC TCTGTCCTGGG] | ['Familial hypercholesterolemia] |
| NM_170707.3(LMNA):<br>c.710T > C<br>(p.Phe237Ser) | 730880132 | LMNA | ['TGAG TYTGA GAGCC GGCTG GCGG'] | ['TGAGTYTGAGA GCCGGCTGGCGG'] | ['Primary dilated cardiomyopathy'] |
| NM_000080.3(CHRNE):<br>c.223T > C<br>(p.Trp75Arg) | 193919341 | — | [ ] | [ ] | ['MYASTHENIC SYNDROME, CONGENITAL, 4B, FAST-CHANNEL'] |
| NM_005211.3(CSF1R):<br>c.2297T > C<br>(p.Met766Thr) | 281860270 | CSF1R | [ ] | [ ] | ['Hereditary diffuse leukoencephalopathy with spheroids'] |
| NM_005211.3(CSF1R):<br>c.2381T > C<br>(p.Ile794Thr) | 281860274 | CSF1R | ['CAAG AYTGG GGACT TCGGG CTGG'] | ['CAAGAYTGGGG ACTTCGGGCTGG'] | ['Hereditary diffuse leukoencephalopathy with spheroids'] |
| NM_005211.3(CSF1R):<br>c.2546T > C<br>(p.Phe849Ser) | 281860277 | CSF1R | [ ] | [ ] | ['Hereditary diffuse leukoencephalopathy with spheroids'] |
| NM_005211.3(CSF1R):<br>c.2624T > C<br>(p.Met875Thr) | 281860279 | CSF1R | [ ] | [ ] | ['Hereditary diffuse leukoencephalopathy with spheroids'] |
| NM_018713.2(SLC30A10):<br>c.266T > C<br>(p.Leu89Pro) | 281860284 | SLC30A10 | [ ] | [ ] | ['Hypermanganesemia with dystonia, polycythemia and cirrhosis'] |
| NM_018713.2(SLC30A10):<br>c.500T > C<br>(p.Phe167Ser) | 281860286 | SLC30A10 | [ ] | ['GGCGCTTYCGGG GGGCCTCAGGG'] | ['Hypermanganesemia with dystonia, polycythemia and cirrhosis'] |
| NM_018713.2(SLC30A10):<br>c.1046T > C<br>(p.Leu349Pro) | 281860291 | SLC30A10 | [ ] | [ ] | ['Hypermanganesemia with dystonia, polycythemia and cirrhosis'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_016218.2(POLK): c.2287T > A (p.Tyr763Asn) | 772307321 | POLK | [ ] | [ ] | ['Malignant tumor of prostate'] |
| NM_000570.4(FCGR3B): c.194A > G (p.Asn65Ser) | 448740 | FCGR3B | [ ] | [ ] | [ ] |
| NM_030653.3(DDX11): c.2271 + 2T > C | 730880279 | DDX11 | ['TCCAGGYGCGGGCGTCATGCTGG'] | ['TCCAGGYGCGGGCGTCATGCTGG', 'CCAGGYGCGGGCGTCATGCTGGG'] | ['Warsaw breakage syndrome'] |
| NM_145693.2(LPIN1): c.1441 + 2T > C | 730880306 | LPIN1 | [ ] | [AAGGYACCGCGGGCCTCGCGCGG', 'AGGYACCGCGGGCCTCGCGCGGG'] | ['Myoglobinuria, acute recurrent, autosomal recessive'] |
| NM_002546.3(TNFRSH1B): c.226A > C (p.Thr76Pro) | 200071478 | TNFRSF11B | [ ] | [ ] | ['Hyperphosphatasemia with bone disease'] |
| NM_000166.5(GJB1): c.145T > C (p.Ser49Pro) | 116840817 | GJB1 | [ ] | [ ] | ['X-linked hereditary motor and sensory neuropathy'] |
| NM_005159.4(ACTC1): c.755T > C (p.Ile252Thr) | 730880398 | — | [ ] | [ ] | ['Cardiomyopathy'] |
| NM_020166.4(MCCC1): c.205A > T (p.Lys69Ter) | 147741073 | MCCC1 | [ ] | [ ] | ['3 Methylcrotonyl-CoA carboxylase 1 deficiency'] |
| NM_000454.4(SOD1): c.338T > C (p.Ile113Thr) | 74315452 | SOD1 | [ ] | ['TTGCAYCATTGGCCGCACACTGG'] | ['Amyotrophic lateral sclerosis type 1'] |
| NM_000169.2(GLA): c.41T > C (p.Leu14Pro) | 730880455 | — | [ ] | ['CGCGCYTGCGCTTCGCTTCCTGG'] | ['not provided'] |
| NM_152743.3(BRAT1): c.176T > C (p.Leu59Pro) | 727505363 | BRAT1 | [ ] | [ ] | ['Rigidity and multifocal seizure syndrome, lethal neonatal'] |
| NM_005633.3(SOS1): c.2104T > C (p.Tyr702His) | 727505381 | SOS1 | [ ] | [ ] | ['Noonan syndrome', 'Rasopathy'] |
| m.1095T > C | 267606618 | MT-RNR1 | [ ] | [ ] | ['Aminoglycoside-induced deafness', 'Auditory neuropathy', 'Deafness, nonsyndromic sensorineural, mitochondrial', 'not specified'] |
| m.1291T > C | 267606620 | MT-RNR1 | [ ] | [ ] | ['Deafness, nonsyndromic sensorineural, mitochondrial'] |
| NM_020247.4(ADCK3): c.1398 + 2T > C | 606231138 | ADCK3 | [ ] | [ ] | ['Coenzyme Q10 deficiency, primary, 4'] |
| NM_000256.3(MYBPC3): c.467T > C (p.Leu156Pro) | 730880616 | MYBPC3 | [ ] | [ ] | ['Cardiomyopathy'] |
| NM_022458.3(LMBR1): c.423 + 4842T > C | 606231149 | LMBR1 | [ ] | [ ] | ['Triphalangeal thumb', 'Preaxial polydactyly 2'] |
| NM_022458.3(LMBR1): c.423 + 4808T > C | 606231152 | LMBR1 | [ ] | [ ] | ['Triphalangeal thumb', 'Preaxial polydactyly 2'] |
| NM_021102.3(SPINT2): c.337 + 2T > C | 606231155 | SPINT2 | [ ] | [ ] | ['Diarrhea 3, secretory sodium, congenital, syndromic'] |
| NM_001004127.2(ALG11): c.257T > C (p.Leu86Ser) | 267606652 | ALG11 | [ ] | [ ] | ['Congenital disorder of glycosylation type 1P'] |
| NM_054027.4(ANKH): c.1015T > C | 267606656 | ANKH | [ ] | ['AGCTCYGTTTCGTGATGTTTTGG'] | ['Craniometaphyseal dysplasia, autosomal |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Cys339Arg) | | | | | dominant'] |
| NM_054027.4(ANKH): c.1172T > C (p.Leu391Pro) | 267606658 | — | [ ] | [ ] | ['Craniometaphyseal dysplasia, autosomal dominant'] |
| NM_175073.2(APTX): c.668T > C (p.Leu223Pro) | 267606665 | APTX | [ ] | [ ] | ['Adult onset ataxia with oculomotor apraxia'] |
| NM_004183.3(BEST1): c.704T > C (p.Val235Ala) | 267606679 | BEST1 | ['CACTGGYGTATACAGGTGAGG'] | ['CACTGGYGTATACACAGGTGAGG'] | ['Vitreoretinochoroidopathy dominant'] |
| NM_004183.3(BEST1): c.614T > C (p.Ile205Thr) | 267606680 | BEST1 | [ ] | [ ] | ['Retinitis pigmentosa 50'] |
| NM_033409.3(SLC52A3): c.670T > C (p.Phe224Leu) | 267606685 | SLC52A3 | [ ] | [ ] | [Brown-Vialetto-Van laere syndrome'] |
| NM_033409.3(SLC52A3): c.1238T > C (p.Val413Ala) | 267606687 | SLC52A3 | [ ] | ['AGTTACGYCAAGGTGATGCTGGG'] | [Brown-Vialetto-Van laere syndrome'] |
| NM_004056.4(CA8): c.298T > C (p.Ser100Pro) | 267606695 | CA8 | [ ] | [ ] | ['Cerebellar ataxia, mental retardation, and dysequilibrium syndrome 3'] |
| NM_000256.3(MYBPC3): c.3713T > C (p.Leu1238Pro) | 730880702 | MYBPC3 | [ ] | [ ] | ['Cardiomyopathy'] |
| NM_001928.2(CFD): c.640T > C (p.Cys214Arg) | 267606721 | CFD | [ ] | ['GGTGYGCGGGGGCGTGCTCGAGG', 'GTGYGCGGGGGCGTGCTCGAGGM | ['Complement factor d deficiency'] |
| NM_005740.2(DNAL4): c.153 + 2T > C | 606231254 | DNAL4 | ['CGAGGYATTGCCAGCAGTGCAGG'] | ['CGAGGYATTGCCAGCAGTGCAGG'] | ['Mirror movements 3'] |
| NM_020975.4(RET): c.2753T > C (p.Met918Thr) | 74799832 | RET | [ ] | [ ] | ['Multiple endocrine neoplasia, type 2a', 'Multiple endocrine neoplasia, type 2b', 'Multiple endocrine neoplasia, type 2', 'Pheochromocytoma', 'not provided'] |
| NM_001849.3(COL6A2): c.2329T > C (p.Cys777Arg) | 267606747 | COL6A2 | [ ] | ['CGCCYGCGACAAGCCACAGCAGG'] | ['Ullrich congenital muscular dystrophy'] |
| NM_001006657.1(WDR35): c.781T > C (p.Trp261Arg) | 431905505 | WDR35 | [ ] | [ ] | ['Short rib polydactyly syndrome 5'] |
| NM_003764.3(STX11): c.173T > C (p.Leu58Pro) | 431905512 | STX11 | ['TGCYGGTGGCCGACGTGAAGCGG'] | ['TGCYGGTGGCCGACGTGAAGCGG'] | ['Hemophagocytic lymphohistiocytosis, familial, 4'] |
| NM_001044.4(SLC6A3): c.671T > C (p.Leu224Pro) | 431905515 | SLC6A3 | [ ] | ['CTGCACCYCCACCAGAGCCATGG'] | ['Infantile Parkinsonism-dystonia'] |
| NM_000277.1(PAH): c.764T > C (p.Leu255Ser) | 62642930 | PAH | [ ] | [ ] | ['Phenylketonuria', 'not provided'] |
| NM_000277.1(PAH): c.932T > C (p.Leu311Pro) | 62642936 | PAH | [ ] | [ ] | ['Phenylketonuria', 'not provided'] |
| NM_000118.3(ENG): c.2T > C (p.Met1Thr) | 267606783 | ENG | [ ] | [ ] | ['Osler hemorrhagic telangiectasia syndrome'] |
| NM_000129.3(F13A1): c.728T > C (p.Met243Thr) | 267606788 | F13A1 | ['TGTGAYGGACAGAGCACAAATGG'] | ['TGTGAYGGACAGAGCACAAATGG'] | ['Factor xiii, a subunit, deficiency of'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000257.3(MYH7): c.1952A > G (p.His651Arg) | 606231328 | MYH7 | [ ] | [ ] | ['Familial cardiomyopathy'] |
| NM_014053.3(FLVCR1): c.574T > C (p.Cys192Arg) | 267606821 | FLVCR1 | [ ] | [ ] | ['Posterior column ataxia with retinitis pigmentosa'] |
| NM_005249.4(FOXG1): c.643T > C (p.Phe215Leu) | 267606828 | FOXG1 | [ ] | [ ] | ['Rett syndrome, congenital variant'] |
| NM_015474.3(SAMHD1): c.1153A > G (p.Met385Val) | 515726140 | SAMHD1 | [ ] | [ ] | ['Aicardi Goutieres syndrome 5'] |
| NM_015474.3(SAMHD1): c.1411-2A > G | 515726141 | SAMHD1 | [ ] | [ ] | ['Aicardi Goutieres syndrome 5'] |
| NM_000180.3(GUCY2D): c.2846T > C (p.Ile949Thr) | 267606857 | GUCY2D | [ ] | ['AGAGAYCGCCA ACATGTCACTGG'] | ['Cone-rod dystrophy 6'] |
| NM_022489.3(INF2): c.556T > C (p.Ser186Pro) | 267606877 | INF2 | [ ] | [ ] | ['Focal segmental glomerulosclerosis 5'] |
| NM_000257.3(MYH7): c.1048T > C (p.Tyr350His) | 730880863 | MYH7 | [ ] | [ ] | ['Cardiomyopathy'] |
| NM_022489.3(INF2): c.125T > C (p.Leu42Pro) | 267606880 | INF2 | [ ] | ['GCTGCYCCAGAT GCCCTCTGTGG'] | ['Focal segmental glomerulosclerosis 5'] |
| m.4681T > C | 267606889 | MT-ND2 | [ ] | [ ] | ['Leigh disease', 'Leigh syndrome due to mitochondrial complex I deficiency'] |
| m.10191T > C | 267606890 | MT-ND3 | [ ] | [ ] | ['Leigh disease', 'Mitochondrial complex I deficiency'] |
| m.10563T > C | 267606892 | MT-ND4L | [ ] | [ ] | ['Familial colorectal cancer'] |
| m.12706T > C | 267606893 | MT-ND5 | [ ] | [ ] | ['Leigh disease', 'Leigh syndrome due to mitochondrial complex I deficiency'] |
| NM_015713.4(RRM2B): c.556A > G (p.Arg186Gly) | 515726190 | RRM2B | [ ] | [ ] | ['RRM2B-related mitochondrial disease'] |
| NM_015713.4(RRM2B): c.581A > G (p.Glu194Gly) | 515726191 | RRM2B | [ ] | ['AACTCCTYCTAC AGCAGCAAAGG'] | ['RRM2B-related mitochondrial disease'] |
| NM_000315.2(PTH): c.52T > C (p.Cys18Arg) | 104894271 | PTH | ['AATT YGTTT TCTTA CAAAA TCGG'] | ['AATTYGTTTCT TACAAAATCGG'] | ['Hypoparathyroidism familial isolated'] |
| NM_001136271.2(NKX2-6): c.451T > C (p.Phe151Leu) | 267606914 | NKX2-6 | [ ] | [ ] | ['Persistent truncus arteriosus'] |
| NM_004646.3(NPHS1): c.793T > C (p.Cys265Arg) | 267606917 | NPHS1 | [ ] | ['GCTGCCGYGCGT GGCCCGAGGGG', 'CTGCCGYGCGTG GCCCGAGGGGG'] | ['Finnish congenital nephrotic syndrome'] |
| NM_000406.2(GNRHR): c.94A > G (p.Thr32Ala) | 515726219 | GNRHR | [ ] | [ ] | ['Hypogonadotropic hypogonadism'] |
| NM_152296.4(ATP1A3): c.2270T > C (p.Leu757Pro) | 606231436 | ATP1A3 | [ ] | [ ] | ['Alternating hemiplegia of childhood 2'] |
| NM_000513.2(OPN1MW): c.529T > C (p.Trp177Arg) | 267606927 | OPN1MW | [ ] | [ ] | ['Cone dystrophy 5, X-linked'] |
| NM_152296.4(ATP1A3): c.1144T > C (p.Trp382Arg) | 606231448 | ATP1A3 | [ ] | [ ] | ['Dystonia 12'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_024411.4(PDYN): c.632T > C (p.Leu211Ser) | 267606940 | PDYN | [ ] | [ ] | ['Spinocerebellar ataxia 23'] |
| NM_000444.5(PHEX): c.755T > C (p.Phe252Ser) | 267606945 | PHEX | [ ] | [ ] | ['Familial X-linked hypophosphatemic vitamin D refractory rickets'] |
| NM_001543.4(NDST1): c.1918T > C (p.Phe640Leu) | 606231458 | NDST1 | [ ] | [ ] | ['Mental retardation, autosomal recessive 46'] |
| NM_013382.5(POMT2): c.2242T > C (p.Trp748Arg) | 267606964 | POMT2 | [ ] | [ ] | ['Congenital muscular dystrophy-dystroglycanopathy with mental retardation, type B2'] |
| NM_006121.3(KRT1): c.482T > C (p.Leu161Pro) | 57695159 | KRT1 | [ ] | [ ] | ['Bullous ichthyosiform erythroderma', 'not provided'] |
| NM_016203.3(PRKAG2): c.1459T > C (p.Tyr487His) | 267606976 | PRKAG2 | [ ] | [ ] | ['Familial hypertrophic cardiomyopathy 6', 'not provided'] |
| NM_016203.3(PRKAG2): c.1642T > C (p.Ser548Pro) | 267606979 | PRKAG2 | [ ] | [ ] | ['Familial hypertrophic cardiomyopathy 6', 'not provided'] |
| NM_198965.1(PTHLH): c.179T > C (p.Leu60Pro) | 267606985 | PTHLH | [ ] | [ ] | ['Brachydactyly type E2'] |
| NM_198965.1(PTHLH): c.131T > C (p.Leu44Pro) | 267606986 | PTHLH | [ ] | [ ] | ['Brachydactyly type E2'] |
| NM_004990.3(MARS): c.1108T > C (p.Phe370Leu) | 140467171 | MARS | [ ] | [ ] | ['Interstitial lung and liver disease'] |
| NM_173560.3(RFX6): c.649T > C (p.Ser217Pro) | 267607012 | RFX6 | [ ] | [ ] | ['Mitchell-Riley syndrome'] |
| NM_002942.4(ROBO2): c.2834T > C (p.Ile945Thr) | 267607014 | ROBO2 | ['GAGAYTGGAAATTTGGCCGTGG'] | ['GAGAYTGGAAATTTTGGCCGTGG'] | ['Vesicoureteral reflux 2'] |
| NM_178857.5(RP1L1): c.2878T > C (p.Trp960Arg) | 267607018 | RP1L1 | [ ] | [ ] | ['Occult macular dystrophy'] |
| NM_002880.3(RAF1): c.1423T > C (p.Phe475Leu) | 730881003 | RAF1 | [ ] | [ ] | ['Rasopathy'] |
| NM_015272.3(RPGRIP1L): c.1975T > C (p.Ser659Pro) | 267607020 | RPGRIP1L | [ ] | [ ] | ['Joubert syndrome 7', 'COACH syndrome'] |
| NM_015559.2(SETBP1): c.2612T > C (p.Ile871Thr) | 267607038 | SETBP1 | [ ] | [ ] | ['Schinzel-Giedion syndrome'] |
| NM_000433.3(NCF2): c.481A > G (p.Lys161Glu) | 137878529 | NCF2 | [ ] | [ ] | ['Chronic granulomatous disease, autosomal recessive cytochrome b-positive, type 2'] |
| NM_001041.3(SI): c.1022T > C (p.Leu341Pro) | 267607049 | SI | [ ] | [ ] | ['Sucrase-isomaltase deficiency'] |
| NM_005633.3(SOS 1): c.1294T > C (p.Trp432Arg) | 267607080 | SOS 1 | ['GGTYGGGAGGGAAAAGACATTGG'] | ['GGTYGGGAGGGAAAAGACATTGG'] | ['Noonan syndrome 4', 'Rasopathy'] |
| NM_018136.4(ASPM): c.2419 + 2T > C | 587783225 | ASPM | [ ] | [ ] | ['Primary autosomal recessive microcephaly 5'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001199107.1(TBC1D24): c.751T > C (p.Phe251Leu) | 267607104 | TBC1D24 | [ ] | ['CAAGTTCYTCCA CAAGGTGAGGG', 'TTCYTCCACAAG GTGAGGGCCGG'] | ['Myoclonic epilepsy, familial infantile'] |
| NM_153704.5(TMEM67): c.1769T > C (p.Phe590Ser) | 267607115 | TMEM67 | [ ] | [ ] | ['Joubert syndrome 6', 'COACH syndrome'] |
| NM_153704.5(TMEM67): c.2498T > C (p.Ile833Thr) | 267607119 | TMEM67 | [ ] | [ ] | ['Joubert syndrome 6', 'COACH syndrome'] |
| NM_133378.4(TTN): c.100163T > C (p.Leu33388Pro) | 267607156 | — | [ ] | [ ] | ['Distal myopathy Markesbery-Griggs type'] |
| m.12811T > C | 199974018 | MT-ND5 | [ ] | [ ] | ['Leber optic atrophy'] |
| NM_144631.5(ZNF513): c.1015T > C (p.Cys339Arg) | 267607182 | ZNF513 | [ ] | ['TGGGCGCYGCAT GCGAGGAGAGG', 'CGCYGCATGCGA GGAGAGGCTGG'] | ['Retinitis pigmentosa 58'] |
| NM_004737.4(LARGE): c.1483T > C (p.Trp495Arg) | 267607209 | LARGE | [ ] | [ ] | ['Congenital muscular dystrophy-dystroglycanopathy with brain and eye anomalies, type A6'] |
| NM_000229.1(LCAT): c.508T > C (p.Trp170Arg) | 267607211 | LCAT | [ ] | ['TATGACYGGCG GCTGGAGCCCGG'] | ['Norum disease'] |
| NM_016269.4(LEF1): c.181T > C (p.Ser61Pro) | 267607215 | — | [ ] | ['GAACGAGYCTG AAATCATCCCGG'] | ['Sebaceous tumors, somatic'] |
| NM_139248.2(LIPH): c.322T > C (p.Trp108Arg) | 267607219 | LIPH | [ ] | [ ] | ['Woolly hair, autosomal recessive 2, with or without hypotrichosis'] |
| NM_004268.4(MED17): c.1112T > C (p.Leu371Pro) | 267607232 | MED17 | [ ] | [ ] | ['Microcephaly, postnatal progressive, with seizures and brain atrophy'] |
| NM_000530.6(MPZ): c.341T > C (p.Ile114Thr) | 267607241 | MPZ | [ ] | [ ] | [ ] |
| NM_000489.4(ATRX): :c.4840T > C (p.Cys1614Arg) | 122445094 | ATRX | [ ] | [ ] | ['ATR-X syndrome'] |
| NM_000489.4(ATRX): c.6250T > C (p.Tyr2084His) | 122445097 | ATRX | [ ] | [ ] | ['ATR-X syndrome'] |
| NM_000489.4(ATRX): c.1226T > C (p.Leu409Ser) | 122445109 | ATRX | [ ] | [ ] | [ ] |
| NM_000489.4(ATRX): c.6149T > C (p.Ile2050Thr) | 122445110 | ATRX | [ ] | [ ] | ['Multiple congenital anomalies'] |
| NM_178151.2(DCX): c.272T > C (p.Leu91Pro) | 587783536 | DCX | [ ] | [ ] | ['Heterotopia'] |
| NM_178151.2(DCX): c.2T > C (p.Met1Thr) | 587783539 | DCX | ['CAAA ATAYG GAACT TGATT TTGG'] | ['CAAAATAYGGA ACTTGATTTTGG'] | ['Heterotopia'] |
| NM_178151.2(DCX): c.412T > C (p.Tyr138His) | 587783551 | DCX | [ ] | [ ] | ['Heterotopia'] |
| NM_000212.2(ITGB3): c.2231T > C (p.Leu744Pro) | 398122374 | — | [ ] | [ ] | ['Platelet-type bleeding disorder 16'] |
| NM_178151.2(DCX): c.641T > C (p.Ile214Thr) | 587783574 | DCX | [ ] | [ ] | ['Heterotopia'] |
| NM_178151.2(DCX): c.683T > C (p.Leu228Pro) | 587783580 | DCX | [ ] | ['AAAAAACYCTA CACTCTGGATGG'] | ['Heterotopia'] |
| NM_001005360.2(DNM2): c.1862T > C (p.Leu621Pro) | 587783597 | DNM2 | [ ] | [ ] | ['Myopathy, centronuclear'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006579.2(EBP): c.310T > C (p.Tyr104His) | 587783609 | EBP | [ ] | [ ] | ['Chondrodysplasia punctata 2 X-linked dominant'] |
| NM_004004.5(GJB2): c.107T > C (p.Leu36Pro) | 587783644 | GJB2 | [ ] | ['GATCCYCGTTGT GGCTGCAAAGG'] | ['Hearing impairment'] |
| NM_005682.6(ADGRG1): c.1460T > C (p.Leu487Pro) | 587783653 | ADGRG1 | [ ] | [VCCTGCYCACCT GCCTTTCCTGG'] | ['Polymicrogyria, bilateral frontoparietal'] |
| NM_000525.3(KCNJ11): c.988T > C (p.Tyr330His) | 587783675 | KCNJ11 | [ ] | [ ] | ['Diabetes mellitus'] |
| NM_170707.3(LMNA): c.799T > C (p.Tyr267His) | 267607593 | LMNA | [ ] | [ ] | ['Dilated cardiomyopathy 1A', 'not provided'] |
| NM_000252.2(MTM1): c.1353 + 2T > C | 587783780 | MTM1 | [ ] | [ ] | ['Severe X-linked myotubular myopathy'] |
| NM_000252.2(MTM1): c.1367T > C (p.Phe456Ser) | 587783783 | MTM1 | [ ] | [ ] | ['Severe X-linked myotubular myopathy'] |
| NM_000252.2(MTM1): c.1433T > C (p.Phe478Ser) | 587783794 | MTM1 | [ ] | [ ] | ['Severe X-linked myotubular myopathy'] |
| NM_000252.2(MTM1): c.1495T > C (p.Trp499Arg) | 587783801 | MTM1 | [ ] | [ ] | ['Severe X-linked myotubular myopathy'] |
| NM_000252.2(MTM1): c.260T > C (p.Leu87Pro) | 587783816 | MTM1 | [ ] | [ ] | ['Severe X-linked myotubular myopathy'] |
| NM_000252.2(MTM1): c.683T > C (p.Leu228Pro) | 587783851 | MTM1 | [ ] | [ ] | ['Severe X-linked myotubular myopathy'] |
| NM_000252.2(MTM1): c.958T > C (p.Ser320Pro) | 587783863 | MTM1 | [ ] | ['GGAAYCTTTAAA AAAAGTGAAGG'] | ['Severe X-linked myotubular myopathy'] |
| NM_000526.4(KRT14): c.1151T > C (p.Leu384Pro) | 59629244 | KRT14 | [ ] | [ ] | ['Epidermolysis bullosa simplex, Koebner type', 'not provided'] |
| NM_000249.3(MLH1): c.453 + 2T > C | 267607751 | MLH1 | [ ] | [ATCACGGYAAG AATGGTACATGG', 'TCACGGYAAGAA TGGTACATGGG'] | ['Hereditary Nonpolyposis Colorectal Neoplasms'] |
| NM_002764.3(PRPS1): c.455T > C (p.Leu152Pro) | 80338676 | PRPS1 | [ ] | [ ] | ['Arts syndrome', 'not provided'] |
| NM_022132.4(MCCC2): c.499T > C (p.Cys167Arg) | 119103222 | MCCC2 | [ ] | [ ] | ['3-methylcrotonyl CoA carboxylase 2 deficiency'] |
| NM_000411.6(HLCS): c.710T > C (p.Leu237Pro) | 119103227 | HLCS | [ ] | ['CTATCYTTCTCA GGGAGGGAAGG'] | ['Holocarboxylase synthetase deficiency'] |
| NM_005787.5(ALG3): c.211T > C (p.Trp71Arg) | 119103237 | ALG3 | [ ] | MATTGACYGGA AGGCCTACATGG'] | ['Congenital disorder of glycosylation type 1D'] |
| NM_005609.2(PYGM): c.1187T > C (p.Leu396Pro) | 119103254 | PYGM | [ ] | [ ] | ['Glycogen storage disease, type V'] |
| m.3250T > C | 199474664 | MT-TL1 | [ ] | [ ] | [ ] |
| NM_002764.3(PRPS1): :c.344T > C (p.Met115Thr) | 80338732 | PRPS1 | ['GCAA ATAYG CTATC TGTAG CAGG'] | ['GCAAATAYGCT ATCTGTAGCAGG'] | [Charcot-Marie-Tooth disease, X-linked recessive, type 5'] |
| NM_003172.3(SURF1): c.679T > C (p.Trp227Arg) | 398122806 | SURF1 | [ ] | ['CCACYGGCATTA TCGAGACCTGG'] | ['Congenital myasthenic syndrome, acetazolamide-responsive'] |
| NM_004525.2(LRP2): c.7564T > C (p.Tyr2522His) | 80338747 | LRP2 | [ ] | ['GTACCTGYACTG GGCTGACTGGG'] | ['Donnai Barrow syndrome'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_006329.3(FBLN5): c.649T > C (p.Cys217Arg) | 80338766 | FBLN5 | [ ] | [ ] | ['Autosomal recessive cutis laxa type IA'] |
| NM_001271723.1(FBXO38): c.616T > C (p.Cys206Arg) | 398122838 | FBXO38 | [ ] | ['TTCCTYGTATCC CAATGCTAAGG'] | ['Distal hereditary motor neuronopathy 2D'] |
| NM_133433.3(NIPBL): c.7062 + 2T > C | 587784032 | NIPBL | [ ] | [ ] | ['Cornelia de Lange syndrome 1'] |
| NM_000334.4(SCN4A): c.4468T > C (p.Phe1490Leu) | 80338790 | SCN4A | [ ] | [ ] | ['Hyperkalemic Periodic Paralysis Type 1'] |
| NM_058216.2(RAD51C): c.404 + 2T > C | 730881931 | RAD51C | [ ] | [ ] | ['Hereditary cancer-predisposing syndrome'] |
| NM_001111.4(ADAR): c.2615T > C (p.Ile872Thr) | 398122897 | ADAR | [ ] | [ ] | ['Aicardi-goutieres syndrome 6'] |
| NM_005334.2(HCFC1): c.-970T > C | 398122908 | HCFC1 | ['CAAG AYGGC GGCTC CCAGG GAGG'] | ['CAAGAYGGCGG CTCCCAGGGAGG'] | ['Mental retardation 3, X-linked'] |
| NM_000431.3(MVK): c.1039 + 2T > C | 398122910 | MVK | ['CCAG GYATC CCGGG GGTAG GTGG'] | ['CCAGGYATCCCG GGGTAGGTGG', 'CAGGYATCCCGG GGGTAGGTGGG'] | ['Porokeratosis, disseminated superficial actinic 1'] |
| NM_000431.3(MVK): c.1094T > C (p.Phe365Ser) | 398122911 | MVK | [ ] | [ ] | ['Porokeratosis, disseminated superficial actinic 1'] |
| NM_005050.3(ABCD4): c.956A > G (p.Tyr319Cys) | 201777056 | ABCD4 | ['GATG AGGYA GATGC ACACA AAGG'] | ['GATGAGGYAGA TGCACACAAAGG'] | ['METHYLMALONIC ACIDURIA AND HOMOCYSTINURI A, cblJ TYPE', 'not provided'] |
| NM_000251.2(MSH2): c.2005 + 2T > C | 267607987 | MSH2 | ['CTGG YAAAA AACCT GGTTT TTGG', 'TGGYA AAAAA CCTGG TTTTTG GG'] | ['CTGGYAAAAAA CCTGGTTTTTGG', 'TGGYAAAAAACC TGGTTTTTGGG'] | ['Hereditary Nonpolyposis Colorectal Neoplasms'] |
| NM_000518.4(HBB): c.257T > C (p.Phe86Ser) | 35693898 | HBB | [ ] | [ ] | ['Hemoglobinopathy'] |
| NM_001194998.1(CEP152): c.3149T > C (p.Leu1050Pro) | 398122977 | CEP152 | [ ] | [ ] | ['Primary autosomal recessive microcephaly 9'] |
| NM_022455.4(NSD1): c.5989T > C (p.Tyr1997His) | 587784171 | NSD1 | [ ] | [ ] | ['Sotos syndrome 1'] |
| NM_014495.3(ANGPTL3): c.883T > C (p.Phe295Leu) | 398122989 | — | [ ] | ['ACAAAACYTCA ATGAAACGTGGG'] | ['Hypobetalipoprotei nemia, familial, 2'] |
| NM_024577.3(SH3TC2): c.1982T > C (p.Leu661Pro) | 80338927 | SH3TC2 | [ ] | [ ] | ['Charcot-Marie-Tooth disease, type 4C'] |
| NM_000551.3(VHL): c.227T > C (p.Phe76Ser) | 730882033 | VHL | [ ] | [ ] | ['Hereditary cancer-predisposing syndrome'] |
| NM_004004.5(GJB2): c.269T > C (p.Leu90Pro) | 80338945 | GJB2 | [ ] | ['GCTCCYAGTGGC CATGCACGTGG'] | ['Deafness, autosomal recessive 1A', 'Hearing impairment', 'not provided'] |
| NM_000334.4(SCN4A): c.2078T > C (p.Ile693Thr) | 80338956 | SCN4A | [ ] | ['AAGATCAYTGG CAATTCAGTGGG', 'AGATCAYTGGCA | ['Hyperkalemic Periodic Paralysis Type 1', |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_004523.3(KIF11): c.2547 + 2T > C | 730882063 | KIF11 | ['GGAG GYAAT AACTT TGTAA GTGG'] | ATTCAGTGGGG', 'GATCAYTGGCAA TTCAGTGGGGG'] ['GGAGGYAATAA CTTTGTAAGTGG'] | 'Paramyotonia congenita of von Eulenburg'] ['Microcephaly with or without chorioretinopathy, lymphedema, or mental retardation'] |
| NM_003060.3(SLC22A5): c.1051T > C (p.Trp351Arg) | 68018207 | SLC22A5 | [ ] | [ ] | ['Renal carnitine transport defect'] |
| NM_001070.4(TUBG1): c.1160T > C (p.Leu387Pro) | 398123045 | TUBG1 | [ ] | [ ] | ['Cortical dysplasia, complex, with other brain malformations 4'] |
| NM_000441.1(SLC26A4): c.-103T > C | 60284988 | — | [ ] | [ ] | ['Pendred syndrome', 'Enlarged vestibular aqueduct syndrome'] |
| NM_000016.5(ACADM): c.233T > C (p.Ile78Thr) | 398123074 | ACADM | [ ] | [ ] | ['Medium-chain acyl-coenzyme A dehydrogenase deficiency', 'not provided'] |
| NM_000179.2(MSH6): c.4001 + 2T > C | 267608131 | MSH6 | [ ] | [VGGYAACTAACT AACTATAATGG] | ['Hereditary Nonpolyposis Colorectal Neoplasms'] |
| NM_000019.3(ACAT1): c.730 + 2T > C | 398123096 | ACAT1 | [ ] | [ ] | ['Deficiency of acetyl-CoA acetyltransferase', 'not provided'] |
| NM_000430.3(PAFAH1B1): c.841T > C (p.Cys281Arg) | 587784288 | PAFAH1B1 | [ ] | [ ] | ['Lissencephaly 1'] |
| NM_000899.4(KITLG): c.98T > C (p.Val33Ala) | 730882156 | KITLG | [ ] | [ ] | ['Familial progressive hyperpigmentation with or without hypopigmentation'] |
| NM_015599.2(PGM3): c.248T > C (p.Leu83Ser) | 267608260 | PGM3 | ['AATG TYGGC ACCAT CCTGG GAGG'] | ['AATGTYGGCACC ATCCTGGGAGG'] | ['Immunodeficiency 23'] |
| NM_000169.2(GLA): c.899T > C (p.Leu300Pro) | 398123223 | — | [ ] | [ ] | ['Fabry disease'] |
| NM_001256047.1(C19orf12): c.391A > G (p.Lys131Glu) | 146170087 | C19orf12 | [ ] | [ ] | ['Neurodegeneration with brain iron accumulation 4'] |
| NM_172337.2(0TX2): c.674A > G (p.Asn225Ser) | 370761964 | OTX2 | [ ] | [ ] | ['Pituitary hormone deficiency, combined 6'] |
| NM_000202.6(IDS): c.587T > C (p.Leu196Ser) | 398123250 | IDS | [ ] | [ ] | ['Mucopolysaccharid osis, MPS-II', 'not provided'] |
| NM_000252.2(MTM1): c.688T > C (p.Trp230Arg) | 398123274 | MTM1 | [ ] | [ ] | ['Severe X-linked myotubular myopathy', 'not provided'] |
| NM_022445.3(TPK1): c.656A > G (p.Asn219Ser) | 371271054 | TPK1 | [ ] | [ ] | ['THIAMINE METABOLISM DYSFUNCTION SYNDROME 5 (EPISODIC ENCEPHALOPATHY TYPE)'] |
| NM_014139.2(SCN11A): c.2432T > C (p.Leu811Pro) | 483352920 | SCN11A | [ ] | [ ] | ['NEUROPATHY, HEREDITARY SENSORY AND AUTONOMIC, TYPE VII'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_000733.3(CD3E): c.520 + 2T > C | 483352928 | CD3E | [ ] | [ ] | ['Immunodeficiency 18'] |
| NM_017653.3(DYM): c.621-2A > G | 775414124 | DYM | [ ] | [ ] | ['Dyggve-Melchior-Clausen syndrome'] |
| NM_001253816.1(SL052A2): c.1016T > C (p.Leu339Pro) | 148234606 | 5LC52A2 | [ ] | [ ] | [Brown-Vialetto-Van Laere syndrome 2'] |
| NM_004963.3(GUCY2C): c.2782T > C (p.Cys928Arg) | 587784573 | — | [ ] | ['TCCCYGTGCTGC TGGAGTTGTGG', 'CCCYGTGCTGCT GGAGTTGTGGG'] | ['Meconium ileus'] |
| NM_003159.2(CDKL5): c.659T > C (p.Leu220Pro) | 267608511 | CDKL5 | [ ] | ['CCAACYTTTTAC TATTCAGAAGG'] | ['Early infantile epileptic encephalopathy 2'] |
| NM_000528.3(MAN2B1): c.2436 + 2T > C | 398123457 | MAN2B1 | [ ] | [ ] | ['not provided'] |
| NM_002136.2(HNRNPA1): c.841T > C (p.Phe281Leu) | 483353031 | HNRNPA1 | ['AATY TTGGA GGCAG AAGCT CTGG'] | ['AATYTTGGAGGC AGAAGCTCTGG'] | ['Chronic progressive multiple sclerosis'] |
| NM_006920.4(SCN1A): c.4251 + 2T > C | 398123595 | — | [ ] | [ ] | ['Severe myoclonic epilepsy in infancy', 'Generalized epilepsy with febrile seizures plus, type 2'] |
| NM_002225.3(IVD): c.465 + 2T > C | 398123683 | IVD | [ ] | [ ] | ['Isovaleryl-CoA dehydrogenase deficiency', 'not provided'] |
| NM_000118.3(ENG): c.1273-2A > G | 373842615 | ENG | [ ] | ['CCGCCYGCGGG GATAAAGCCAGG', 'CGCCYGCGGGGA TAAAGCCAGGG'] | ['Haemorrhagic telangiectasia 1'] |
| NM_005859.4(PURA): c.218T > C (p.Phe73Ser) | 793888535 | PURA | [ ] | [ ] | ['not provided'] |
| NM_003494.3(DYSF): c.1284 + 2T > C | 398123765 | DYSF | ['ATGG YAAGG AGCAA GGGAG CAGG'] | ['ATGGYAAGGAG CAAGGGAGCAGG'] | ['Limb-girdle muscular dystrophy, type 2B', 'not provided'] |
| NM_004006.2(DMD): c.2380 + 2T > C | 398123885 | DMD | [ ] | [ ] | ['Dilated cardiomyopathy 3B'] |
| NM 006364.2(SEC23): c.2104A > G (p.Met702Val) | 138568622 | SEC23A | [ ] | [ ] | ['Craniolenticulosutural dysplasia'] |
| NM_000335.4(SCN5A): c.376A > G (p.Lys126Glu) | 185492581 | SCN5A | [ ] | ['GAATCTYCACAG CCGCTCTCCGG'] | ['Brugada syndrome'] |
| NM_015865.6(SLC14Al): c.871T > C (p.Ser291Pro) | 78242949 | SLC14A1 | [ ] | [ ] | [ ] |
| NM_003995.3(NPR2): c.226T > C (p.Ser76Pro) | 796065355 | NPR2 | [ ] | [ ] | ['SHORT STATURE WITH NONSPECIFIC SKELETAL ABNORMALITIES'] |
| NM_012463.3(ATP6V0A2): c.825 + 2T > C | 398124257 | ATP6V0A2 | ['CACT GYGAG TAAGC TGGAA GTGG'] | ['CACTGYGAGTA AGCTGGAAGTGG'] | ['Cutis laxa with osteodystrophy', 'not provided'] |
| NM_014795.3(ZEB2): c.73 + 2T > C | 398124282 | ZEB2 | [ ] | [ ] | ['Mowat-Wilson syndrome'] |
| NM_000424.3(KRT5): c.1388T > C (p.Leu463Pro) | 57599352 | KRT5 | [ ] | [ ] | ['Epidermolysis bullosa simplex, Koebner type', 'not provided'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_133499.2(SYN1): c.1699A > G (p.Thr567Ala) | 200533370 | SYN1 | [ ] | ['GATGYCTGACGGGTAGCCTGTGG', 'ATGYCTGACGGGTAGCCTGTGGG'] | ['Epilepsy, X-linked, with variable learning disabilities and behavior disorders', 'not specified'] |
| NM_148960.2(CLDN19): c.269T > C (p.Leu90Pro) | 118203981 | CLDN19 | [ ] | ['GCTCCYGGGCTTCGTGGCCATGG'] | ['Hypomagnesemia 5, renal, with ocular involvement'] |
| NM_018006.4(TRMU): c.229T > C (p.Tyr77His) | 118203990 | TRMU | [ ] | [ ] | ['Liver failure acute infantile'] |
| NM_000056.3(BCKDHB): c.752T > C (p.Val251Ala) | 398124593 | BCKDHB | [ ] | [ ] | ['Maple syrup urine disease', 'not provided'] |
| NM_182680.1(AMELX): c.2T > C (p.Met1Thr) | 104894737 | — | [ ] | [ ] | ['Amelogenesis imperfecta, type 1E'] |
| NM_018105.2(THAP1): c.241T > C (p.Phe81Leu) | 118204013 | THAP1 | [ ] | [ ] | ['Dystonia 6, torsion'] |
| NM_001235.3(SERPINH1): c.233T > C (p.Leu78Pro) | 137853892 | SERPINH1 | [ ] | [GTCGCYAGGGCTCGTGTCGCTGG', 'TCGCYAGGGCTGTGTCGCTGGG'] | ['Osteogenesis imperfecta type 10'] |
| NM_004482.3(GALNT3): c.516_688del | 761396172 | GALNT3 | [ ] | [ ] | ['Tumoral calcinosis, familial, hyperphosphatemic'] |
| NM_000263.3(NAGLU): c.142T > C (p.Phe48Leu) | 118204024 | NAGLU | [ ] | ['GGCCGACYTCTCCGTGTCGGTGG'] | ['Mucopolysaccharidosis, MPS-III-B'] |
| NM_000559.2(HBG1): c.-251T > C | 35710727 | HBG1 | [ ] | [ ] | ['Fetal hemoglobin quantitative trait locus 1'] |
| NM_000527.4(LDLR): c.694 + 2T > C | 200238879 | LDLR | ['CGGYATGGGCGGGGCCAGGGTGG'] | ['ACTGCGGYATGGGCGGGGCCAGG', 'CTGCGGYATGGGCGGGGCCAGGG', 'CGGYATGGGCGGGCCAGGGTGG'] | ['Familial hypercholesterolemia'] |
| NM_001012515.2(FECH): c.1268T > C (p.Phe423Ser) | 118204039 | FECH | [ ] | [ ] | ['Erythropoietic protoporphyria'] |
| NM_005211.3(CSF1R): c.1745T > C (p.Leu582Pro) | 690016563 | CSF1R | [ ] | ['CAACCYGCAGTTTGGTGAGATGG'] | ['Hereditary diffuse leukoencephalopathy with spheroids'] |
| NM_000526.4(KRT14): c.1243T > C (p.Tyr415His) | 58380626 | KRT14 | [ ] | ['CGCCACCYACCGCCGCCTGCTGG', 'CACCYACCGCCGCCTGCTGGAGG', 'ACCYACCGCCGCCTGCTGGAGGG'] | ['Epidermolysis bullosa herpetiformis, Dowling-Meara', 'not provided'] |
| NM_006493.2(CLN5): c.2T > C (p.Met1Thr) | 201615354 | CLN5 | [ ] | [ ] | ['not provided'] |
| NM_002863.4(PYGL): c.2461T > C (p.Tyr821His) | 113993988 | PYGL | ['AAGAAYATGCCCAAAACATCTGG'] | ['AAGAAYATGCCCAAAACATCTGG'] | ['Glycogen storage disease, type VI'] |
| NM_016038.2(SBDS): c.258 + 2T > C | 113993993 | SBDS | [ ] | [ ] | ['Shwachman syndrome', 'Aplastic anemia, susceptibility to'] |
| NM_000110.3(DPYD): c.85T > C (p.Cys29Arg) | 1801265 | DPYD | [ ] | [ ] | ['Dihydropyrimidine dehydrogenase deficiency'] |
| NM_001034116.1(EIF2B4): c.1393T > C (p.Cys465Arg) | 113994038 | EIF2B4 | [ ] | [ ] | ['Ovarioleukodystrophy'] |
| NM_001165963.1(SCN1A): c.323T > C (p.Leu108Pro) | 794726793 | SCN1A | [ ] | [ ] | ['Severe myoclonic epilepsy in infancy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001034116.1(EIF2B4):<br>c.1465T > C<br>(p.Tyr489His) | 113994040 | EIF2B4 | [ ] | [ ] | ['Ovarioleukodystrophy'] |
| NM_004304.4(ALK):<br>c.3749T > C<br>(p.Ile1250Thr) | 113994092 | ALK | [ ] | [ ] | ['Neuroblastoma 3'] |
| NM_207346.2(TSEN54):<br>c.277T > C<br>(p.Ser93Pro) | 113994151 | TSEN54 | [ ] | ['TTGAAGYCTCCC GCGGTGAGCGG', 'AAGYCTCCCGCG GTGAGCGGCGG'] | ['Pontocerebellar hypoplasia type 4'] |
| NM_000018.3(ACADVL):<br>c.848T > C<br>(p.Val283Ala) | 113994167 | ACADVL | ['TTTGY GGTGG AGAGG GGCTT CGG', 'TTGYG GTGGA GAGGG GCTTC GGG'] | ['TTTGYGGTGGAG AGGGGCTTCGG', 'TTGYGGTGGAGA GGGGCTTCGGG'] | ['Very long chain acyl-CoA dehydrogenase deficiency', 'not provided'] |
| NM_000430.3(PAFAH1B1):<br>c.569-10T > C | 113994202 | PAFAH1B1 | [ ] | [ ] | ['Lissencephaly 1'] |
| NM_004937.2(CTNS):<br>c.473T > C<br>(p.Leu158Pro) | 113994206 | CTNS | [ ] | ['TGGTCYGAGCTT CGACTTCGTGG'] | ['Cystinosis'] |
| NM_000546.5(TP53):<br>c.488A > G<br>(p.Tyr163Cys) | 148924904 | TP53 | ['GCTTG YAGAT GGCCA TGGCG CGG'] | ['GCTTGYAGATGG CCATGGCGCGG'] | ['Hereditary cancer-predisposing syndrome'] |
| NM_004211.3(SLC6A5):<br>c.1444T > C<br>(p.Trp482Arg) | 281864925 | SLC6A5 | [ ] | [ ] | ['Hyperekplexia 3'] |
| NM_024312.4(GNPTAB):<br>c.1208T > C<br>(p.Ile403Thr) | 281864973 | GNPTAB | [ ] | [ ] | ['Pseudo-Hurler polydystrophy'] |
| NM_024312.4(GNPTAB):<br>c.3002T > C<br>(p.Leu1001Pro) | 281865006 | GNPTAB | [ ] | [ ] | ['I cell disease'] |
| NM_000540.2(RYR1):<br>c.7358T > C<br>(p.Ile2453Thr) | 118192123 | RYR1 | [ ] | [ ] | ['Central core disease', 'not provided'] |
| NM_000748.2(CHRNB2):<br>c.923T > C<br>(p.Val308Ala) | 281865070 | CHRNB2 | [ ] | [ ] | ['Epilepsy, nocturnal frontal lobe, type 3'] |
| NM_000526.4(KRT14):<br>c.356T > C<br>(p.Met119Thr) | 28928893 | KRT14 | [ ] | [ ] | ['Epidermolysis bullosa herpetiformis, Dowling-Meara', 'not provided'] |
| NM_000093.4(COL5A1):<br>c.5137-11T > A | 183495554 | — | [ ] | [ ] | ['Ehlers-Danlos syndrome, classic type'] |
| NM_000277.1(PAH):<br>c.638T > C<br>(p.Leu213Pro) | 62516109 | PAH | [ ] | [CCACTTCYTGAA AAGTACTGTGG] | ['Phenylketonuria', 'not provided'] |
| NM_000531.5 (OTC):<br>c.663 + 2T > C | 72558427 | OTC | [ ] | [ ] | ['not provided'] |
| NM_000531.5 (OTC):<br>c.717 + 2T > C | 72558431 | OTC | [ ] | [ ] | [Ornithine carbamoyltransferas e deficiency', 'not provided'] |
| NM_000531.5 (OTC):<br>c.793T > C<br>(p.Trp265Arg) | 72558445 | OTC | [ ] | [ ] | ['not provided'] |
| NM_000493.3(COL10A1):<br>c.1841T > C<br>(p.Leu614Pro) | 111033545 | — | [ ] | [ ] | ['Metaphyseal chondrodysplasia, Schmid type'] |
| NM_000493.3(COL10A1):<br>c.1771T > C<br>(p.Cys591Arg) | 111033546 | — | [ ] | [ ] | ['Metaphyseal chondrodysplasia, Schmid type'] |
| NM_000493.3(COL10A1):<br>c.2011T > C | 111033552 | — | [ ] | [ ] | ['Metaphyseal chondrodysplasia, |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Ser671Pro) | | | | | Schmid type'] |
| NM_004614.4(TK2): c.173A > G (p.Asn58Ser) | 138439950 | TK2 | [ ] | [ ] | ['Mitochondrial DNA depletion syndrome 2'] |
| NM_004614.4(TK2): c.644T > C (p.Leu215Pro) | 281865497 | TK2 | [ ] | [ ] | ['Mitochondrial DNA depletion syndrome 2'] |
| NM_004614.4(TK2): c.156 + 2T > C | 281865499 | TK2 | [ ] | [ ] | ['Mitochondrial DNA depletion syndrome 2'] |
| NM_153026.2(PRICKLE1): c.1414T > C (p.Tyr472His) | 281865564 | PRICKLE1 | [ ] | [ ] | ['Progressive myoclonus epilepsy with ataxia'] |
| NM_017882.2(CLN6): c.767A > G (p.Asp256Gly) | 143781303 | CLN6 | [ ] | [ ] | ['not provided'] |
| NM_130838.1(UBE3A): c.389T > C (p.Ile130Thr) | 111033597 | UBE3A | [ ] | [ ] | ['Angelman syndrome'] |
| NM_001198799.2(ASCC1): c.953A > G (p.Asn318Ser) | 146370051 | ASCC1 | [ ] | [ ] | [ ] |
| NM_000174.4(GP9): c.70T > C (p.Cys24Arg) | 28933378 | GP9 | ['CCCAYGTACCTGCCGCGCCCTGG'] | [VCCAYGTACCTGCCGCGCCCTGG'] | ['Bernard Soulier syndrome', 'Bernard-Soulier syndrome type C'] |
| NM_001173464.1(KIF21A): c.3029T > C (p.Ile1010Thr) | 121912587 | KIF21A | [ ] | [ ] | ['Fibrosis of extraocular muscles, congenital, 1'] |
| NM_001302946.1(TRNT1): c.668T > C (p.Ile223Thr) | 370011798 | TRNT1 | [ ] | ['GCAAYTGCAGAAAATGCAAAAGG'] | ['Sideroblastic anemia with B-cell immunodeficiency, periodic fevers, and developmental delay'] |
| NM_000371.3(TTR): c.250T > C (p.Phe84Leu) | 121918091 | TTR | [ ] | [ ] | ['Amyloidogenic transthyretin amyloidosis'] |
| m.5814T > C | 200077222 | MT-TC | [ ] | [ ] | ['Juvenile myopathy, encephalopathy, lactic acidosis AND stroke'] |
| NM_000277.1(PAH): c.293T > C (p.Leu98Ser) | 62517167 | PAH | [ ] | ['AAGATCTYGAGGCATGACATTGG'] | ['Mild non-PKU hyperphenylalanemia', 'not provided'] |
| NM_017882.2(CLN6): c.486 + 2T > C | 796052355 | CLN6 | [ ] | [ ] | ['not provided'] |
| NM_001813.2(CENPE): c.4063A > G (p.Lys1355Glu) | 141488085 | CENPE | [ ] | [ ] | ['Primary autosomal recessive microcephaly 13'] |
| NM_001918.3(DBT): c.1150G > A (p.Gly384Ser) | 12021720 | DBT | [ ] | ['GACYCACAGAGCCCAATTTCTGG'] | ['Intermediate maple syrup urine disease type 2'] |
| NM_000495.4(COL4A5): c.4699T > C (p.Cys1567Arg) | 104886288 | COL4A5 | ['AGTAYGTGAAGCTCCAGCTGTGG'] | ['AGTAYGTGAAGCTCCAGCTGTGG'] | ['Alport syndrome, X-linked recessive'] |
| NM_000495.4(COL4A5): c.4756T > C (p.Cys1586Arg) | 104886289 | COL4A5 | [ ] | ['TCCCCATYGCCTCAGGGATGGG'] | ['Alport syndrome, X-linked recessive'] |
| NM_000495.4(COL4A5): c.5032T > C (p.Cys1678Arg) | 104886310 | COL4A5 | [ ] | [ ] | ['Alport syndrome, X-linked recessive'] |
| NM_000155.3(GALT): c.482T > C (p.Leu161Pro) | 111033700 | GALT | ['AGCYGGGTGCCCAGTACCCTTGG'] | ['AGCYGGGTGCCCAGTACCCTTGG'] | ['Deficiency of UDPglucose-hexose- 1-phosphate uridylyltransferase'] |
| NM_001199252.2(SGOL1): c.67A > G (p.Lys23Glu) | 199815268 | — | [ ] | [ ] | ['Chronic atrial and intestinal dysrhythmia'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NC_012920.1:m.5559 A > G | 370471013 | MT-TW | [ ] | ['CAACYTACTGAG GGCTTTGAAGG'] | ['Leigh disease'] |
| NM_000487.5(ARSA): c.410T > C (p.Leu137Pro) | 121434215 | ARSA | [ ] | ['GCCTTCCYGCCC CCCCATCAGGG'] | ['Metachromatic leukodystrophy, adult type'] |
| NM_000051.3(ATM): c.7967T > C (p.Leu2656Pro) | 121434218 | — | [ ] | [ ] | [ ] |
| NM_000096.3(CP): c.650T > C (p.Phe217Ser) | 386134125 | CP | [ ] | [ ] | ['Deficiency of ferroxidase'] |
| NM_000096.3(CP): c.1123T > C (p.Tyr375His) | 386134128 | CP | [ ] | ['ACACTACYACAT TGCCGCTGAGG'] | ['Deficiency of ferroxidase'] |
| NM_000268.3(NF2): c.185T > C (p.Phe62Ser) | 121434261 | NF2 | [ ] | [ ] | ['Neurofibromatosis, type 2'] |
| NM_000495.4(COL4A5): c.4803 + 121T > C | 104886423 | COL4A5 | [ ] | [ ] | ['Alport syndrome, X-linked recessive'] |
| NM_024529.4(CDC73): c.191T > C (p.Leu64Pro) | 121434264 | CDC73 | [ ] | [ ] | ['Hyperparathyroidism 1'] |
| NM_001061.4(TBXAS1): c.1463T > C (p.Leu488Pro) | 199422114 | TBXAS1 | [ ] | [ ] | [ ] |
| NM_001127328.2(ACADM): c.1136T > C (p.Ile379Thr) | 121434275 | ACADM | [ ] | ['GTGCAGAYACTT GGAGGCAATGG'] | ['Medium-chain acyl-coenzyme A dehydrogenase deficiency'] |
| NM_001127328.2(ACADM): c.742T > C (p.Cys248Arg) | 121434276 | ACADM | [ ] | [CAGCGAYGTTCA GATACTAGAGG] | ['Medium-chain acyl-coenzyme A dehydrogenase deficiency'] |
| NM_000016.5(ACADM): c.199T > C (p.Tyr67His) | 121434280 | ACADM | [ ] | [ ] | ['Medium-chain acyl-coenzyme A dehydrogenase deficiency', 'not provided'] |
| NM_002225.3(IVD): c.134T > C (p.Leu45Pro) | 121434284 | IVD | [ ] | [ATGGGCYAAGC GAGGAGCAGAGG] | ['ISOVALERIC ACIDEMIA, TYPE I'] |
| NM_005957.4(MTHFR): c.968T > C (p.Leu323Pro) | 121434297 | MTHFR | [ ] | [ ] | ['Homocystinuria due to MTHFR deficiency'] |
| NM_000136.2(FANCC): c.1661T > C (p.Leu554Pro) | 104886458 | — | [ ] | [ ] | ['Fanconi anemia, complementation group C', 'not provided'] |
| NM_005908.3(MANBA): c.1513T > C (p.Ser505Pro) | 121434334 | MANBA | [ ] | ['ATTACGYCCAGT CCTACAAATGG', 'TTACGYCCAGTC CTACAAATGGG', 'TACGYCCAGTCC TACAAATGGGG'] | [Beta-D-mannosidosis] |
| NM_000244.3(MEN1): c.518T > C (p.Leu173Pro) | 386134256 | MEN1 | [ ] | [ ] | ['Multiple endocrine neoplasia, type 1'] |
| NM_199242.2(UNC13D): c.1208T > C (p.Leu403Pro) | 121434353 | UNC13D | [ ] | [ ] | ['Hemophagocytic lymphohistiocytosis, familial, 3'] |
| NM_152783.4(D2HGDH): c.1331T > C (p.Val444Ala) | 121434360 | D2HGDH | [ ] | [ ] | ['D-2-hydroxyglutaric aciduria 1'] |
| NM_207118.2(GTF2H5): c.62T > C (p.Leu21Pro) | 121434365 | GTF2H5 | [ ] | [ ] | ['Photosensitive trichothiodystrophy'] |
| NM_000159.3(GCDH): c.883T > C (p.Tyr295His) | 121434366 | GCDH | [ ] | ['CGCCCGGYACG GCATCGCGTGGG', 'GCCCGGYACGGC ATCGCGTGGGG'] | ['Glutaric aciduria, type 1'] |
| NM_018668.4(VPS33B): c.89T > C (p.Leu30Pro) | 121434385 | VPS33B | [ ] | [ ] | ['Arthrogryposis renal dysfunction cholestasis syndrome'] |
| NM_000424.3(KRT5): c.541T > C | 60715293 | KRT5 | [ ] | [GTTTGCCYCCTT CATCGACAAGG] | ['Epidermolysis bullosa |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Ser181Pro) | | | | | herpetiformis, Dowling-Meara', 'not provided'] |
| NM_001003722.1(GLE1): c.2051T > C (p.Ile684Thr) | 121434409 | GLE1 | [ ] | ['AAGGACAYTCCT GTCCCCAAGGG'] | ['Lethal arthrogryposis with anterior horn cell disease'] |
| NM_003659.3(AGPS): c.1406T > C (p.Leu469Pro) | 121434413 | AGPS | [ ] | [ ] | ['Rhizomelic chondrodysplasia punctata type 3'] |
| NM_004550.4(NDUFS2): c.1237T > C (p.Ser413Pro) | 121434429 | NDUFS2 | [ ] | [ ] | ['Mitochondrial complex I deficiency', 'not provided'] |
| NM_001287.5(CLCN7): c.2297T > C (p.Leu766Pro) | 121434434 | CLCN7 | [ ] | ['GGGCCYGCGGC ACCTGGTGGTGG'] | ['Osteopetrosis autosomal recessive 4'] |
| m.14709T > C | 121434453 | MT-TE | [ ] | [ ] | ['Diabetes-deafness syndrome maternally transmitted'] |
| NM_000466.2(PEX1): c.1991T > C (p.Leu664Pro) | 121434455 | PEX1 | [ ] | ['GATGACCYTGAC CTCATTGCTGG'] | ['Zellweger syndrome'] |
| NM_198253.2(TERT): c.3043T > C (p.Cys1015Arg) | 199422307 | TERT | [ ] | [ ] | ['Aplastic anemia'] |
| m.4290T > C | 121434469 | MT-TI | ['ACTYT GATAG AGTAA ATAAT AGG'] | ['ACTYTGATAGAG TAAATAATAGG'] | [ ] |
| m.4291T > C | 121434471 | MT-TI | ['ACTTY GATAG AGTAA ATAAT AGG'] | ['ACTTYGATAGAG TAAATAATAGG'] | ['Hypertension, hypercholesterolemia, and hypomagnesemia, mitochondrial'] |
| m.9997T > C | 121434475 | MT-TG | [ ] | [ ] | ['Primary familial hypertrophic cardiomyopathy'] |
| NM_001099274.1(TINF2): c.860T > C (p.Leu287Pro) | 199422316 | TINF2 | [ ] | [ ] | ['Dyskeratosis congenita autosomal dominant'] |
| NM_001099274.1(TINF2): c.862T > C (p.Phe288Leu) | 199422317 | TINF2 | [ ] | ['CTGYTTCCCTTT AGGAATCTCGM | ['Aplastic anemia'] |
| NM_000430.3(PAFAH1B1): c.505T > C (p.Ser169Pro) | 121434484 | PAFAH1B1 | [ ] | [ ] | ['Subcortical band heterotopia'] |
| NM_000430.3(PAFAH1B1): c.92T > C (p.Phe31Ser) | 121434486 | PAFAH1B1 | [ ] | [ ] | ['Lissencephaly 1'] |
| NM_005535.2(IL12RB1): c.592T > C (p.Cys198Arg) | 121434495 | IL12RB1 | [ ] | [ ] | ['Immunodeficiency 301 |
| NM_030662.3(MAP2K2): c.400T > C (p.Tyr134His) | 121434499 | MAP2K2 | [ ] | [ ] | ['Cardiofaciocutaneo us syndrome 4', 'Rasopathy', 'Noonan syndrome and Noonan-related syndrome'] |
| NM_001065.3(TNFRSF1A): c.349T > C (p.Cys117Arg) | 104895221 | TNFRSF1A | [ ] | ['CTCTTCTYGCAC AGTGGACCGGG'] | ['TNF receptor-associated periodic fever syndrome (TRAPS)'] |
| NM_000123.3(ERCC5): c.2573T > C (p.Leu858Pro) | 121434575 | — | [ ] | [ ] | ['Xeroderma pigmentosum, group G'] |
| NM_001493.2(GDI1): c.275T > C (p.Leu92Pro) | 121434607 | GDI1 | [ ] | [ ] | ['X-Linked Mental Retardation 41'] |
| NM_020061.5(0PN1LW): c.607T > C | 121434621 | OPN1LW | [ ] | [ ] | ['Cone monochromatism'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Cys203Arg) | | | | | |
| NM_024420.2(PLA2G4A): c.331T > C (p.Ser111Pro) | 121434634 | PLA2G4A | [ ] | [ ] | [ ] |
| NM_005557.3(KRT16): c.395T > C (p.Leu132Pro) | 60944949 | KRT16 | [ ] | [ ] | ['Pachyonychia congenita, type 1', 'not provided'] |
| NM_000485.2(APRT): c.407T > C (p.Met136Thr) | 28999113 | APRT | [ ] | [ ] | ['Adenine phosphoribosyltransferase deficiency', 'APRT deficiency, Japanese type'] |
| NM_005270.4(GLI2): c.4663T > C (p.Ser1555Pro) | 144372453 | GLI2 | [ ] | [ ] | ['Holoprosencephaly 9', 'not specified'] |
| NM_024753.4(TTC21B): c.2384T > C (p.Leu795Pro) | 387907060 | TTC21B | [ ] | [ ] | ['Asphyxiating thoracic dystrophy 4'] |
| NM_000155.3(GALT): c.680T > C (p.Leu227Pro) | 111033846 | GALT | [ ] | [ ] | ['Deficiency of UDPglucose-hexose-1-phosphate uridylyltransferase'] |
| NM_000138.4(FBN1): c.4987T > C (p.Cys1663Arg)10): | 137854459 | FBN1 | [ ] | ['GGGACAYGTTACAACACCGTTGG'] | ['Marfan syndrome'] |
| NM_032446.2(MEGF c.976T > C (p.Cys326Arg) | 387907073 | MEGF10 | [ ] | [ ] | ['Myopathy, areflexia, respiratory distress, and dysphagia, early-onset, mild variant'] |
| NM_024027.4(COLEC11): c.505T > C (p.Ser169Pro) | 387907075 | COLEC11 | [ ] | ['CAGCTGYCCTGCCAGGGCCGCGG', 'AGCTGYCCTGCCAGGGCCGCGGG', 'GCTGYCCTGCCAGGGCCGCGGGG', 'CTGYCCTGCCAGGGCCGCGGGGG'] | ['Carnevale syndrome'] |
| NM_001946.3(DUSP6): c.566A > G (p.Asn189Ser) | 143946794 | DUSP6 | ['CACTAYTGGGGTCTCGGTCAAGG'] | ['CACTAYTGGGGTCTCGGTCAAGG'] | ['Hypogonadotropic hypogonadism 19 with or without anosmia'] |
| NM_000138.4(FBN1): c.3793T > C (p.Cys1265Arg) | 137854474 | FBN1 | ['CTTGYGTTATGATGGATTCATGG'] | ['CTTGYGTTATGATGGATTCATGG'] | ['Marfan syndrome'] |
| NM_022068.3(PIEZO2): c.2134A > G (p.Met712Val) | 587777453 | PIEZO2 | [ ] | [ ] | ['Oculomelic amyoplasia'] |
| NM_000570.4(FCGR3B): c.316A= (p.Ile106=) | 2290834 | FCGR3B | [ ] | [ ] | [ ] |
| NM_000352.4(ABCC8): c.674T > C (p.Leu225Pro) | 1048095 | ABCC8 | [ ] | ['TGCYGTCCAAAGGCACCTACTGG'] | ['Permanent neonatal diabetes mellitus'] |
| NM_153490.2(KRT13): c.332T > C (p.Leu111Pro) | 59897026 | KRT13 | [ ] | [ ] | ['White sponge nevus 2', 'not provided'] |
| NM_000132.3(F8): c.1174T > C (p.Ser392Pro) | 28933669 | F8 | [ ] | [ ] | ['Hereditary factor VIII deficiency disease'] |
| NM_000492.3(CFTR): c.1021T > C (p.Ser341Pro) | 397508144 | CFTR | [ ] | [ ] | ['Cystic fibrosis'] |
| NM_000133.3(F9): c.1058T > C (p.Val353Ala) | 137852255 | F9 | [ ] | [ ] | ['Hereditary factor IX deficiency disease'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001202.3(BMP4): c.362A > G (p.His121Arg) | 376960358 | BMP4 | ['TTCGTGGYGGAAGCTCCTCACGG'] | ['TTCGTGGYGGAAGCTCCTCACGG'] | ['Microphthalmia syndromic 6'] |
| NM_000133.3(F9): c.1328T > C (p.Ile443Thr) | 137852268 | F9 | ['GAAYATATACCAAGGTATCCCGG'] | ['GAAYATATACCAAGGTATCCCGG'] | ['Hereditary factor IX deficiency disease'] |
| NM_000133.3(F9): c.1357T > C (p.Trp453Arg) | 137852269 | F9 | [ ] | [ ] | ['Hereditary factor IX deficiency disease'] |
| NM_000435.2(NOTCH3): c.1363T > C (p.Cys455Arg) | 28933698 | NOTCH3 | ['ACCYGTATCTGTATGGCAGGTGG'] | ['TTCACCYGTATCTGTATGGCAGG', 'ACCYGTATCTGTATGGCAGGTGG'] | ['Cerebral autosomal dominant arteriopathy with subcortical infarcts and leukoencephalopath 3'] |
| NM_019074.3(DLL4): c.1168T > C (p.Cys390Arg) | 796065347 | DLL4 | [ ] | ['GAAYGTCCCCCCAACTTCACCGG'] | ['Adams-Oliver syndrome', 'ADAMS-OLIVER SYNDROME 6'] |
| NM_000032.4(ALAS2): c.595T > C (p.Tyr199His) | 137852310 | ALAS2 | [ ] | [ ] | ['Hereditary sideroblastic anemia'] |
| NM_019074.3(DLL4): c.583T > C (p.Phe195Leu) | 796065351 | DLL4 | [ ] | [ ] | ['Adams-Oliver syndrome'] |
| NM_000402.4(G6PD): c.1054T > C (p.Tyr352His) | 137852347 | G6PD | [ ] | ['AGGGYACCTGGACGACCCCACGG'] | ['Anemia, nonspherocytic hemolytic, due to G6PD deficiency'] |
| NM_007325.4(GRIA3): c.2117T > C (p.Met706Thr) | 137852352 | GRIA3 | [ ] | [ ] | ['Mental retardation, X-linked, syndromic, wu type'] |
| NM_000132.3(F8): c.6554T > C (p.Leu2185Ser) | 137852365 | F8 | [ ] | [ ] | ['Hereditary factor VIII deficiency disease'] |
| NM_000132.3(F8): c.5372T > C (p.Met1791Thr) | 137852375 | F8 | ['TCAYGGTGAGTTAAGGACAGTGG'] | ['TCAYGGTGAGTTAAGGACAGTGG'] | ['Hereditary factor VIII deficiency disease'] |
| NM_000132.3(F8): c.1754T > C (p.Ile585Thr) | 137852376 | F8 | ['AACAGAYAATGTCAGACAAGAGG'] | ['AACAGAYAATGTCAGACAAGAGG'] | ['Hereditary factor VIII deficiency disease'] |
| NM_001127695.1(CTSA): c.707T > C (p.Leu236Pro) | 137854546 | CTSA | [ ] | [ ] | ['Galactosialidosis, early infantile'] |
| NM_000132.3(F8): c.935T > C (p.Phe312Ser) | 137852405 | F8 | [ ] | [ ] | ['Hereditary factor VIII deficiency disease'] |
| NM_000132.3(F8): c.980T > C (p.Leu327Pro) | 137852407 | F8 | [ ] | [ ] | ['Hereditary factor VIII deficiency disease'] |
| NM_000308.2(CTSA): c.1271T > C (p.Met424Thr) | 137854548 | CTSA | [ ] | [ ] | ['Galactosialidosis, late infantile'] |
| NM_000132.3(F8): c.1481T > C (p.Ile494Thr) | 137852413 | F8 | [ ] | [ ] | ['Hereditary factor VIII deficiency disease'] |
| NM_001250.5(CD40): c.247T > C (p.Cys83Arg) | 28931586 | CD40 | [ ] | [ ] | ['Immunodeficiency with hyper IgM type 3'] |
| NM_000165.4(GJA1): c.32T > C (p.Leu11Pro) | 121912969 | GJA1 | [ ] | [ ] | ['Oculodentodigital dysplasia'] |
| NM_000132.3(F8): c.1958T > C (p.Val653Ala) | 137852430 | F8 | [ ] | [ ] | ['Hereditary factor VIII deficiency disease'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_001972.2(ELANE): c.211T > C (p.Cys71Arg) | 28931611 | ELANE | [ ] | [ ] | ['Severe congenital neutropenia autosomal dominant'] |
| NM_000098.2(CPT2): c.1342T > C (p.Phe448Leu) | 74315297 | CPT2 | [ ] | [ ] | ['CARNITINE PALMITOYLTRA NSFERASE II DEFICIENCY, LATE-ONSET', 'not provided'] |
| NM_213653.3(HFE2): c.842T > C (p.Ile281Thr) | 74315326 | HFE2 | [ ] | [ ] | ['Hemochromatosis type 2A'] |
| NM_213653.3(HFE2): c.302T > C (p.Leu101Pro) | 74315327 | HFE2 | [ ] | ['GGACCYCGCCTT CCATTCGGCGG'] | ['Hemochromatosis type 2A'] |
| NM_000194.2(HPRT1): c.122T > C (p.Leu41Pro) | 137852480 | HPRT1 | [ ] | [ ] | ['Lesch-Nyhan syndrome'] |
| NM_000261.1(MY0C): c.1297T > C (p.Cys433Arg) | 74315338 | MY0C | [ ] | [ ] | ['Primary open angle glaucoma juvenile onset 1'] |
| NM_000194.2(HPRT1): c.170T > C (p.Met57Thr) | 137852495 | HPRT1 | [ ] | [ ] | ['Lesch-nyhan syndrome, neurologic variant'] |
| NM_000267.3(NF1): c.3728T > C (p.Leu1243Pro) | 137854564 | NF1 | [ ] | [ ] | ['Neurofibromatosis, type 1'] |
| NM_000291.3(PGK1): c.263T > C (p.Leu88Pro) | 137852531 | PGK1 | [ ] | [ ] | ['Phosphoglycerate kinase 1 deficiency'] |
| NM_000291.3(PGK1): c.946T > C (p.Cys316Arg) | 137852533 | PGK1 | [ ] | [ ] | ['Phosphoglycerate kinase 1 deficiency'] |
| NM_000291.3(PGK1): c.758T > C (p.Ile253Thr) | 137852534 | PGK1 | [ ] | [ ] | ['Phosphoglycerate kinase 1 deficiency'] |
| NM_170784.2(MKKS): c.830T > C (p.Leu277Pro) | 74315398 | MKKS | [ ] | [ ] | ['Bardet-Biedl syndrome 6', 'not provided'] |
| NM_000451.3(SHOX): c.877T > C (p.Ter293Arg) | 137852559 | SHOX | [ ] | [ ] | [Leri Weill dyschondrosteosis'] |
| NM_001029871.3(RSPO4): c.319T > C (p.Cys107Arg) | 74315421 | RSPO4 | [ ] | [ ] | ['Anonychia'] |
| NM_000044.3(AR): c.2033T > C (p.Leu678Pro) | 137852579 | AR | [ ] | ['GTCCYGGAAGC CATTGAGCCAGG'] | [ ] |
| NM_000044.3(AR): c.2423T > C (p.Met808Thr) | 137852592 | AR | [ ] | [ ] | ['Reifenstein syndrome'] |
| NM_000044.3(AR): c.2596T > C (p.Ser866Pro) | 137852597 | AR | [ ] | [ ] | ['Androgen resistance syndrome'] |
| NM_172201.1(KCNE2): c.161T > C (p.Met54Thr) | 74315447 | KCNE2 | [ ] | [ ] | ['Long QT syndrome 6', 'Congenital long QT syndrome', 'Cardiac arrhythmia'] |
| NM_172201.1(KCNE2): c.170T > C (p.Ile57Thr) | 74315448 | KCNE2 | [ ] | [ ] | ['Long QT syndrome 6', 'Cardiac arrhythmia', 'not provided'] |
| NM_000211.4(ITGB2): c.446T > C (p.Leu149Pro) | 137852611 | ITGB2 | ['AGCY AGGTG GCGAC CTGCT CCGG'] | ['AGCYAGGTGGC GACCTGCTCCGG'] | ['Leukocyte adhesion deficiency'] |
| NM_000211.4(ITGB2): c.412T > C (p.Ser138Pro) | 137852617 | ITGB2 | [ ] | [ ] | ['Leukocyte adhesion deficiency'] |
| NM_000023.2(SGCA): c.524T > C | 137852622 | SGCA | [ ] | [ ] | ['Limb-girdle muscular dystrophy, |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| (p.Val175Ala) | | | | | type 2D'] |
| NM_001166107.1(HMGCS2): c.520T > C (p.Phe174Leu) | 137852636 | HMGCS2 | [ ] | ['CCCTCYTCAATG CTGCCAACTGG'] | ['mitochondrial 3-hydroxy-3-methylglutaryl-CoA synthase deficiency'] |
| NM_001886.2(CRYBA4): c.281T > C (p.Phe94Ser) | 74315486 | CRYBA4 | [ ] | [ ] | ['Cataract 23'] |
| NM_001886.2(CRYBA4): c.206T > C (p.Leu69Pro) | 74315487 | CRYBA4 | [ ] | [ ] | ['Cataract 23'] |
| NM_002047.2(GARS): c.548T > C (p.Leu183Pro) | 137852644 | GARS | [ ] | [ ] | ['Distal hereditary motor neuronopathy type 5'] |
| NM_000268.3(NF2): c.1604T > C (p.Leu535Pro) | 74315493 | NF2 | [ ] | [ ] | ['Neurofibromatosis, type 2'] |
| NM_000095.2(COMP): c.982T > C (p.Cys328Arg) | 137852653 | COMP | [ ] | [ ] | ['Pseudo-achondroplastic spondyloepiphyseal dysplasia syndrome'] |
| NM_000095.2(COMP): c.1042T > C (p.Cys348Arg) | 137852656 | COMP | [ ] | [ ] | ['Pseudo-achondroplastic spondyloepiphyseal dysplasia syndrome'] |
| NM_017929.5(PEX26): c.2T > C (p.Met1Thr) | 74315506 | PEX26 | [ ] | [ ] | ['Peroxisome biogenesis disorder 7B'] |
| NM_033163.3(FGF8): c.118T > C (p.Phe40Leu) | 137852661 | FGF8 | [ ] | ['TTCCCTGYTCCG GGCTGGCCGGG'] | ['Kallmann syndrome 6'] |
| NM_007315.3(STAT1): c.2117T > C (p.Leu706Ser) | 137852677 | STAT1 | [ ] | [ ] | ['Immunodeficiency 31a'] |
| NM_007315.3(STAT1): c.1799T > C (p.Leu600Pro) | 137852678 | STAT1 | [ ] | [ ] | ['Mycobacterial and viral infections, susceptibility to, autosomal recessive'] |
| NM_000336.2(SCNN1B): c.1858T > C (p.Tyr620His) | 137852707 | SCNN1B | [ ] | [ ] | ['Pseudoprimary hyperaldosteronism'] |
| NM_005215.3(DCC): c.503T > C (p.Met168Thr) | 121912967 | DCC | [ ] | ['AGCCCAYGCCA ACAATCCACTGG'] | [ ] |
| NM_001034850.2(FAM134B): c.873 + 2T > C | 137852738 | FAM134B | [ ] | [ ] | ['Hereditary sensory and autonomic neuropathy type IIA'] |
| NM_000182.4(HADHA): c.1025T > C (p.Leu342Pro) | 137852772 | HADHA | [ ] | [ ] | ['Mitochondrial trifunctional protein deficiency'] |
| NM_001165974.1(UROC1): c.209T > C (p.Leu70Pro) | 137852796 | UROC1 | [ ] | [ ] | ['Urocanate hydratase deficiency'] |
| NM_000405.4(GM2A): c.412T > C (p.Cys138Arg) | 137852797 | GM2A | [ ] | [ ] | ['Tay-Sachs disease, variant AB'] |
| NM_001039523.2(CHRNA1): c.901T > C (p.Phe301Leu) | 137852806 | CHRNA1 | [ ] | ['TGTGYTCCTTCT GGTCATCGTGG'] | ['Myasthenic syndrome, congenital, fast-channel'] |
| NM_003688.3(CASK): c.802T > C (p.Tyr268His) | 137852817 | CASK | [ ] | [ ] | ['FG syndrome 4'] |
| NM_003688.3(CASK): c.2740T > C (p.Trp914Arg) | 137852819 | CASK | ['CACA GYGGG TCCCT GTCTC CTGG', 'ACAGY GGGTC CCTGT | ['CACAGYGGGTC CCTGTCTCCTGG', 'ACAGYGGGTCCC TGTCTCCTGGG'] | ['FG syndrome 4'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | CTCCTGGG'] | | |
| NM_182760.3(SUMF1): c.1006T > C (p.Cys336Arg) | 137852848 | SUMF1 | [ ] | [ ] | ['Multiple sulfatase deficiency'] |
| NM_182760.3(SUMF1): c.463T > C (p.Ser155Pro) | 137852850 | SUMF1 | [ ] | ['GGCGACYCCTTT GTCTTTGAAGG'] | ['Multiple sulfatase deficiency', 'not provided'] |
| NM_000158.3(GBE1): c.671T > C (p.Leu224Pro) | 137852886 | GBE1 | [ ] | ['AATGTACYACCA AGAATCAAAGG'] | ['Glycogen storage disease, type IV', 'GLYCOGEN STORAGE DISEASE IV, NONPROGRESSIVE HEPATIC'] |
| m.8356T > C | 118192099 | MT-TK | [ ] | [ ] | ['Myoclonus with epilepsy with ragged red fibers', 'MERRF/MELAS overlap syndrome'] |
| NM_024312.4(GNPTAB): c.1120T > C (p.Phe374Leu) | 137852900 | GNPTAB | [ ] | [ ] | ['Pseudo-Hurler polydystrophy', 'I cell disease'] |
| NM_031924.4(RSPH3): c.631-2A > G | 142800871 | RSPH3 | [ ] | [ ] | ['Kartagener syndrome'] |
| NM_058172.5(ANTXR2): c.566T > C (p.Ile189Thr) | 137852905 | ANTXR2 | [ ] | [ ] | ['Hyaline fibromatosis syndrome'] |
| NM_000419.3(ITGA2B): c.641T > C (p.Leu214Pro) | 137852911 | ITGA2B | [ ] | [CTGGTGCYTGGG GCTCCTGGCGG'] | ['Glanzmann thrombasthenia'] |
| NM_001171507.2(MCFD2): c.407T > C (p.Ile136Thr) | 137852914 | MCFD2 | [ ] | [ ] | ['Factor v and factor viii, combined deficiency of, 2'] |
| NM_000540.2(RYR1): c.1205T > C (p.Met402Thr) | 118192117 | RYR1 | ['CGCA YGATC CACAG CACCA ATGG'] | ['CGCAYGATCCAC AGCACCAATGG'] | ['Congenital myopathy with fiber type disproportion', 'Central core disease', 'not provided'] |
| NM_000540.2(RYR1): c.13703T > C (p.Leu4568Pro) | 118192131 | RYR1 | [ ] | [ ] | ['Central core disease', 'not provided'] |
| NM_000540.2(RYR1): c.13949T > C (p.Leu4650Pro) | 118192138 | RYR1 | [ ] | [ ] | ['Central core disease', 'not provided'] |
| NM_138694.3(PKHD1): c.10658T > C (p.Ile3553Thr) | 137852948 | PKHD1 | [ ] | ['GAGCCCAYTGA AATACGCTCAGG'] | ['Polycystic kidney disease, infantile type'] |
| NM_012464.4(TLL1): c.713T > C (p.Val238Ala) | 137852952 | TLL1 | ['GGGA TTGYT GTTCA TGAAT TGGG'] | ['GGGATTGYTGTT CATGAATTGGG'] | ['Atrial septal defect 6'] |
| NM_000540.2(RYR1): c.14762T > C (p.Phe4921Ser) | 118192156 | RYR1 | [ ] | [ ] | ['Central core disease', 'not provided'] |
| NM_024960.4(PANK2): c.178T > C (p.Ser60Pro) | 137852964 | PANK2 | [ ] | ['ATTGACYCAGTC GGATTCAATGG'] | [ ] |
| NM_001001486.1(ATP2C1): c.1751T > C (p.Leu584Pro) | 137853015 | ATP2C1 | [ ] | [ ] | ['Familial benign pemphigus'] |
| NM_014363.5(SACS): c.5836T > C (p.Trp1946Arg) | 137853017 | SACS | [ ] | [ ] | ['Spastic ataxia Charlevoix-Saguenay type'] |
| NM_014363.5(SACS): c.9742T > C (p.Trp3248Arg) | 137853018 | SACS | [ ] | [ ] | ['Spastic ataxia Charlevoix-Saguenay type'] |
| NM_014363.5(SACS): c.3161T > C (p.Phe1054Ser) | 137853019 | SACS | [ ] | [ ] | ['Spastic ataxia Charlevoix-Saguenay type'] |
| NM_006899.3(IDH3B): | 137853020 | IDH3B | [ ] | ['TGCGGCYGAGG | ['Retinitis |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| c.395T > C (p.Leu132Pro) | | | | TAGGTGGTCTGG', 'GCGGCYGAGGTA GGTGGTCTGGG'] | pigmentosa 46'] |
| NM_001139.2(ALOX12B): c.1277T > C (p.Leu426Pro) | 137853023 | ALOX12B | [ ] | [ ] | ['Autosomal recessive congenital ichthyosis 2'] |
| NM_001080463.1(DYNC2H1): c.3719T > C (p.Ile1240Thr) | 137853028 | DYNC2H1 | [ ] | [ ] | ['Short-rib thoracic dysplasia 3 with or without polydactyly'] |
| NM_006009.3(TUBA1A): c.1190T > C (p.Leu397Pro) | 137853048 | TUBA1A | [ ] | [ ] | ['Lissencephaly 3'] |
| NM_004519.3(KCNQ3): c.925T > C (p.Trp309Arg) | 118192249 | KCNQ3 | [ ] | [ ] | ['Benign familial neonatal seizures 2'] |
| NM_000531.5 (OTC): c.332T > C (p.Leu111Pro) | 1800324 | OTC | [ ] | [ ] | [Ornithine carbamoyltransferase deficiency'] |
| NM_001172567.1(MYD88): c.317T > C (p.Leu106Pro) | 137853065 | MYD88 | [ ] | [ ] | ['Myd88 deficiency'] |
| NM_002241.4(KCNJ10): c.418T > C (p.Cys140Arg) | 137853068 | KCNJ10 | [ ] | [ ] | [SeSAME syndrome'] |
| NM_000455.4(STK11): c.200T > C (p.Leu67Pro) | 137853077 | STK11 | [ ] | [ ] | ['Peutz-Jeghers syndrome'] |
| NM_000518.4(HBB): c.332T > C (p.Leu111Pro) | 35256489 | HBB | [ ] | [ ] | ['Beta thalassemia major'] |
| NM_005094.3(5LC27A4): c.739T > C (p.Ser247Pro) | 137853133 | 5LC27A4 | [ ] | [ ] | ['Ichthyosis prematurity syndrome'] |
| NM_001145308.4(LRTOMT): c.313T > C (p.Trp105Arg) | 137853186 | LRTOMT | [ ] | [ ] | ['Deafness, autosomal recessive 631 |
| NM_178012.4(TUBB2B): c.514T > C (p.Ser172Pro) | 137853194 | TUBB2B | [ ] | [ ] | ['Polymicrogyria, asymmetric'] |
| NM_178012.4(TUBB2B): c.683T > C (p.Leu228Pro) | 137853195 | TUBB2B | [ ] | [ ] | ['Polymicrogyria, asymmetric'] |
| NM_178012.4(TUBB2B): c.793T > C (p.Phe265Leu) | 137853196 | TUBB2B | [ ] | [ ] | ['Polymicrogyria, asymmetric'] |
| NM_001082971.1(DDC): c.925T > C (p.Phe309Leu) | 137853209 | DDC | [ ] | [ ] | ['Deficiency of aromatic-L-amino-acid decarboxylase'] |
| NM_006121.3(KRT1): c.1424T > C (p.Leu475Pro) | 137853225 | KRT1 | [ ] | [ ] | ['Bullous ichthyosiform erythroderma'] |
| NM_033500.2(HK1): c.1550T > C (p.Leu517Ser) | 137853249 | HK1 | [ ] | ['GACTTCTYGGCC CTGGATCTTGG', 'TTCTYGGCCCTG GATCTTGGAGG'] | ['Hemolytic anemia due to hexokinase deficiency'] |
| NM_000249.3(MLH1): c.229T > C (p.Cys77Arg) | 63749859 | MLH1 | [ ] | [ ] | ['Hereditary Nonpolyposis Colorectal Neoplasms'] |
| NM_000444.5(PHEX): c.1664T > C (p.Leu555Pro) | 137853270 | PHEX | [ ] | ['AGCYCCAGAAG CCTTTCTTTTGG'] | ['Familial X-linked hypophosphatemic vitamin D refractory rickets'] |
| NM_000321.2(RB1): c.2134T > C (p.Cys712Arg) | 137853296 | RB1 | [ ] | [ ] | ['Retinoblastoma'] |
| NM_007313.2(ABL1): c.988T > C (p.Phe330Leu) | 137853304 | ABL1 | [ ] | [ ] | [ ] |
| NM_003639.4(IKBKG): c.1249T > C (p.Cys417Arg) | 137853325 | IKBKG | [ ] | ['TGGAGYGCATTG AGTAGGGCCGG'] | ['Hypohidrotic ectodermal dysplasia with immune |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | | | deficiency', 'Hyper-IgM immunodeficiency, X-linked, with hypohidrotic ectodermal dysplasia'] |
| NM_017534.5(MYH2): c.5609T > C (p.Leu1870Pro) | 786201023 | — | [ ] | [ ] | ['Inclusion body myopathy 3'] |
| NM_000314.6(PTEN): c.406T > C (p.Cys136Arg) | 786201044 | PTEN | [ ] | [ ] | ['Hereditary cancer-predisposing syndrome'] |
| NM_001257988.1(TYMP): c.665A > G (p.Lys222Arg) | 149977726 | TYMP | ['CACGAGTYTCTTACTGAGAATGG'] | ['CACGAGTYTCTTACTGAGAATGG', 'GAGTYTCTTACTGAGAATGGAGG'] | [ ] |
| NM_016725.2(FOLR1): c.493 + 2T > C | 144637717 | FOLR1 | ['AGGYGAGGGCTGGGGTGGGCAGG'] | ['CTTCAGGYGAGGGCTGGGGTGGG', 'AGGYGAGGGCTGGGGTGGGCAGG'] | ['not provided'] |
| NM_002225.3(IVD): c.295 + 2T > C | 748026507 | IVD | [ ] | [ ] | ['not provided'] |
| NM_000175.3(GPI): c.1016T > C (p.Leu339Pro) | 137853587 | GPI | [ ] | [ ] | [ ] |
| NM_002055.4(GFAP): c.1055T > C (p.Leu352Pro) | 28932769 | GFAP | [ ] | ['GGACCYGCTCAATGTCAAGCTGG'] | ['Alexander disease', 'not provided'] |
| NM_020921.3(NIN): c.3665A > G (p.Gln1222Arg) | 187464517 | NIN | [ ] | [ ] | ['Seckel syndrome 7'] |
| NM_005603.4(ATP8B1) :c.2097 + 2T > C | 387906381 | ATP8B1 | [ ] | [ ] | ['Progressive intrahepatic cholestasis'] |
| NM_005144.4(HR): c.-320T > C | 387906382 | HR | [ ] | [ ] | ['Marie Unna hereditary hypotrichosis 1'] |
| NM_001303.3(COX10): c.2T > C (p.Met1Thr) | 387906383 | COX10 | [ ] | [ ] | ['Congenital myasthenic syndrome, acetazolamide-responsive'] |
| NM_004415.2(DSP): c.4961T > C (p.Leu1654Pro) | 749730642 | DSP | [ ] | [ ] | ['not provided'] |
| NM_000392.4(ABCC2): c.1967 + 2T > C | 387906396 | ABCC2 | [ ] | [ ] | ['Dubin-Johnson syndrome'] |
| NM_002769.4(PRSS1): c.116T > C (p.Val39Ala) | 397507439 | — | [ ] | [TACCAGGYGTCCCTGAATTCTGG] | ['Hereditary pancreatitis'] |
| NM_130439.3(MXI1): c.552 + 2T > C | 387906417 | MXI1 | [ ] | [ ] | ['Malignant tumor of prostate'] |
| m.8528T > C | 387906422 | — | [ ] | [ ] | ['Cardiomyopathy, infantile hypertrophic'] |
| NM_000132.3(F8): c.985T > C (p.Cys329Arg) | 387906430 | F8 | [ ] | [ ] | ['Hereditary factor VIII deficiency disease'] |
| NM_000132.3(F8): c.1417T > C (p.Tyr473His) | 387906443 | F8 | [ ] | [ ] | ['Hereditary factor VIII deficiency disease'] |
| NM_000132.3(F8): c.1729T > C (p.Ser577Pro) | 387906446 | F8 | [ ] | ['AAAGAAYCTGTAGATCAAAGAGG'] | ['Hereditary factor VIII deficiency disease'] |
| NM_004333.4(BRAF): c.1403T > C (p.Phe468Ser) | 397507473 | BRAF | ['ATCATYTGGAACAGTCTACAAGG', 'TCATYTGGAACAGTC | ['ATCATYTGGAACAGTCTACAAGG', 'TCATYTGGAACAGTCTACAAGGG'] | ['Cardiofaciocutaneous syndrome', 'Rasopathy'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | TACAAGGG'] | | |
| NM_004333.4(BRAF): c.1454T > C (p.Leu485Ser) | 397507475 | BRAF | [ ] | [ ] | ['Cardiofaciocutaneous syndrome', 'Rasopathy'] |
| NM_005188.3(CBL): c.1201T > C (p.Cys401Arg) | 397507492 | CBL | [ ] | [ ] | ['Rasopathy'] |
| NM_000133.3(F9): c.52T > C (p.Cys18Arg) | 387906474 | F9 | [ ] | [ ] | ['Hereditary factor IX deficiency disease'] |
| NM_005249.4(FOXG1): c.700T > C (p.Ser234Pro) | 786205008 | FOXG1 | [ ] | [ ] | ['Rett syndrome, congenital variant', 'not provided'] |
| NM_000133.3(F9): c.82T > C (p.Cys28Arg) | 387906481 | F9 | [ ] | [ ] | ['Hereditary factor IX deficiency disease'] |
| NM_000133.3(F9): c.1031T > C (p.Ile344Thr) | 387906482 | F9 | [ ] | ['ACGAACAYCTTCCTCAAATTTGG'] | ['Hereditary factor IX deficiency disease'] |
| m.11253T > C | 200145866 | MT-ND4 | [ ] | [ ] | ['Leber optic atrophy'] |
| NM_000131.4(F7): c.38T > C (p.Leu13Pro) | 387906507 | F7 | [ ] | [ ] | ['Factor VII deficiency'] |
| NM_000131.4(F7): c.983T > C (p.Phe328Ser) | 387906508 | F7 | [ ] | ['GACGTYCTCTGAGAGGACGCTGG'] | ['Factor VII deficiency'] |
| NM_000422.2(KRT17): c.296T > C (p.Leu99Pro) | 28933089 | KRT17 | [ ] | [ ] | ['Pachyonychia congenita type 2', 'not provided'] |
| NM_001040113.1(MYH11): c.3791T > C (p.Leu1264Pro) | 387906532 | MYH11 | [ ] | ['GAAGCYGGAGGCGCAGGTGCAGG'] | ['Aortic aneurysm, familial thoracic 4'] |
| NM_013246.2(CLCF1): c.46T > C (p.Cys16Arg) | 137853934 | — | [ ] | [ ] | ['Cold-induced sweating syndrome 2'] |
| NM_013246.2(CLCF1): c.676T > C (p.Ter226Arg) | 137853935 | — | [ ] | [ ] | ['Cold-induced sweating syndrome 2'] |
| NM_001077620.2(PRCD): c.2T > C (p.Met1Thr) | 527236092 | — | [ ] | [ ] | ['Retinitis pigmentosa'] |
| NM_000488.3(SERPINC1): c.68T > C (p.Leu23Pro) | 387906575 | SERPINC1 | [ ] | [ ] | ['Antithrombin III deficiency'] |
| NM_206933.2(USH2A): c.9751T > C (p.Cys3251Arg) | 527236118 | USH2A | [ ] | [ ] | ['Retinitis pigmentosa'] |
| NM_001458.4(FLNC): c.752T > C (p.Met251Thr) | 387906586 | FLNC | [ ] | [ ] | ['Myopathy, distal, 4'] |
| NM_000781.2(CYP11A1): c.665T > C (p.Leu222Pro) | 387906601 | CYP11A1 | [ ] | [ ] | ['Adrenal insufficiency, congenital, with 46,XY sex reversal, partial or complete'] |
| NM_000548.3(TSC2): c.2410T > C (p.Cys804Arg) | 137853995 | TSC2 | [ ] | [ ] | ['Tuberous sclerosis syndrome', 'Tuberous sclerosis 2', 'not provided'] |
| NM_001145661.1(GATA2): c.1117T > C (p.Cys373Arg) | 387906633 | GATA2 | [ ] | [ ] | ['Lymphedema, primary, with myelodysplasia'] |
| NM_002693.2(POLG): c.3470A > G (p.Asn1157Ser) | 548076633 | POLG | ['CAAGAGGYTGGTGATCTGCAAGG'] | ['CAAGAGGYTGGTGATCTGCAAGG'] | ['not provided'] |
| NM_002465.3(MYBPC1): c.706T > C (p.Trp236Arg) | 387906657 | MYBPC1 | [ ] | [ ] | ['Distal arthrogryposis type 1B'] |
| NM_002465.3(MYBPC1): c.2566T > C (p.Tyr856His) | 387906658 | MYBPC1 | [ ] | ['CAAACCYATATCCGCAGAGTTGG'] | ['Distal arthrogryposis type 1B'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_003392.4(WNT5A): c.544T > C (p.Cys182Arg) | 387906663 | WNT5A | [ ] | [ ] | ['Robinow syndrome'] |
| NM_005188.3(CBL): c.1186T > C (p.Cys396Arg) | 387906665 | CBL | [ ] | [ ] | ['Rasopathy'] |
| NM_006902.4(PRRX1): c.338T > C (p.Phe113Ser) | 387906667 | PRRX1 | [ ] | [ ] | ['Dysgnathia complex'] |
| NM_001111035.1(ACP5): c.602T > C (p.Leu201Pro) | 387906672 | — | [ ] | [ ] | ['Spondyloenchondrodysplasia with immune dysregulation'] |
| NM_002734.4(PRKAR1A): c.1117T > C (p.Tyr373His) | 387906693 | PRKAR1A | [ ] | [ ] | ['Acrodysostosis 1 with or without hormone resistance'] |
| NM_002734.4(PRKAR1A): c.980T > C (p.Ile327Thr) | 387906695 | PRKAR1A | [ ] | [ ] | ['Acrodysostosis 1 with or without hormone resistance'] |
| NM_003491.3(NAA10): c.109T > C (p.Ser37Pro) | 387906701 | NAA10 | [ ] | ['TGGCCTTYCCTG GCCCCAGGTGG', 'GGCCTTYCCTGG CCCCAGGTGGG'] | ['N-terminal acetyltransferase deficiency'] |
| NM_006306.3(SMC1A): c.2351T > C (p.Ile784Thr) | 387906702 | SMC1A | ['AGAY TGGTG TGCGC AACAT CCGG'] | ['AGAYTGGTGTGC GCAACATCCGG'] | ['Congenital muscular hypertrophy-cerebral syndrome'] |
| NM_000377.2(WAS): c.814T > C (p.Ser272Pro) | 387906716 | WAS | [ ] | [ ] | ['Severe congenital neutropenia X-linked'] |
| NM_000377.2(WAS): c.881T > C (p.Ile294Thr) | 387906717 | WAS | [ ] | ['GACTTCAYTGAG GACCAGGGTGG', 'ACTTCAYTGAGG ACCAGGGTGGG'] | ['Severe congenital neutropenia X-linked'] |
| m.12201T > C | 387906733 | MT-TH | [ ] | [ ] | ['Deafness, nonsyndromic sensorineural, mitochondrial'] |
| NM_139125.3(MASP1): c.1888T > C (p.Cys630Arg) | 387906753 | MASP1 | [ ] | [ ] | ['Michels syndrome'] |
| NM_007315.3(STAT1): c.520T > C (p.Cys174Arg) | 387906763 | STAT1 | [ ] | [ ] | ['Immunodeficiency 31C'] |
| NM_053025.3(MYLK): c.5275T > C (p.Ser1759Pro) | 387906781 | — | [ ] | [ ] | ['Aortic aneurysm, familial thoracic 7'] |
| NM_000287.3(PEX6): c.1601T > C (p.Leu534Pro) | 387906809 | PEX6 | [ ] | ['CTTCYGGGCCGG GACCGTGATGG', 'TTCYGGGCCGGG ACCGTGATGGG'] | ['Peroxisome biogenesis disorder 4B'] |
| NM_000174.4(GP9): c.167T > C (p.Leu56Pro) | 28933377 | GP9 | [ ] | [ ] | ['Bernard-Soulier syndrome type C'] |
| NM_004153.3(ORC1): c.266T > C (p.Phe89Ser) | 387906827 | ORC1 | [ ] | [ ] | ['Meier-Gorlin syndrome 1'] |
| NM_021252.4(RAB18): c.619T > C (p.Ter207Gln) | 387906833 | RAB18 | [ ] | [ ] | ['Warburg micro syndrome 3'] |
| NM_000702.3(ATP1A2): c.2291T > C (p.Leu764Pro) | 28933398 | ATP1A2 | [ ] | [ ] | ['Familial hemiplegic migraine type 2'] |
| NM_000702.3(ATP1A2): c.2659T > C (p.Trp887Arg) | 28933399 | ATP1A2 | [ ] | [ ] | ['Familial hemiplegic migraine type 2'] |
| NM_000702.3(ATP1A2): c.2192T > C (p.Met731Thr) | 28933400 | ATP1A2 | [ ] | [ ] | ['Familial hemiplegic migraine type 2'] |
| NM_020433.4(JPH2): c.421T > C (p.Tyr141His) | 387906897 | JPH2 | [ ] | [ ] | ['Familial hypertrophic cardiomyopathy 17'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_173170.1(IL36RN): c.80T > C (p.Leu27Pro) | 387906914 | IL36RN | [ ] | [ ] | ['Pustular psoriasis, generalized'] |
| NM_004990.3(MARS): c.1568T > C (p.Ile523Thr) | 201555303 | MARS | [ ] | [ ] | ['Interstitial lung and liver disease'] |
| NM_020191.2(MRPS22): c.644T > C (p.Leu215Pro) | 387906924 | MRPS22 | ['ATCYTAGGGTAAGGTGACTTAGG'] | ['ATCYTAGGGTAAGGTGACTTAGG'] | ['Combined oxidative phosphorylation deficiency 5'] |
| NM_022445.3(TPK1): c.119T > C (p.Leu40Pro) | 387906936 | TPK1 | [ ] | [ ] | ['THIAMINE METABOLISM DYSFUNCTION SYNDROME 5 (EPISODIC ENCEPHALOPATHY TYPE)'] |
| NM_020634.1(GDF3): c.914T > C (p.Leu305Pro) | 387906945 | GDF3 | [ ] | [ ] | ['Congenital ocular coloboma', 'Microphthalmia, isolated 7'] |
| NM_024513.3(FYCO1): c.4127T > C (p.Leu1376Pro) | 387906965 | FYCO1 | [ ] | [CAGCCYGATCCCCATCACTGTGG'] | ['Cataract, autosomal recessive congenital 2'] |
| NM_006147.3(IRF6): c.65T > C (p.Leu22Pro) | 387906967 | IRF6 | [ ] | ['GCCYCTACCCTGGGCTCATCTGG'] | ['Van der Woude syndrome', 'Popliteal pterygium syndrome'] |
| NM_025132.3(WDR19): c.2129T > C (p.Leu710Ser) | 387906980 | WDR19 | [ ] | [ ] | ['Cranioectodermal dysplasia 4', 'SENIOR-LOKEN SYNDROME 8'] |
| NM_025132.3(WDR19): c.20T > C (p.Leu7Pro) | 387906982 | WDR19 | [ ] | ['TCTCACYGCTAGAAAAGACTTGG'] | ['Asphyxiating thoracic dystrophy 5'] |
| NM_014874.3(MFN2): c.647T > C (p.Phe216Ser) | 387906990 | MFN2 | [ ] | [ ] | [ ] |
| NM_016097.4(IER3IP1): c.233T > C (p.Leu78Pro) | 387907012 | IER3IP1 | [ ] | [ ] | ['Microcephaly, epilepsy, and diabetes syndrome'] |
| NM_022489.3(INF2): c.310T > C (p.Cys104Arg) | 387907034 | INF2 | [ ] | [ ] | ['Charcot-Marie-Tooth disease, dominant intermediate E'] |
| NM_022489.3(INF2): c.383T > C (p.Leu128Pro) | 387907037 | INF2 | [ ] | [ ] | ['Charcot-Marie-Tooth disease, dominant intermediate E'] |
| NM_003235.4(TG): c.3229T > C (p.Cys1077Arg) | 137854433 | TG | [ ] | [ ] | ['Iodotyrosyl coupling defect'] |
| NM_058246.3(DNAJB6): c.277T > C (p.Phe93Leu) | 387907046 | DNAJB6 | [ ] | [ ] | ['Limb-girdle muscular dystrophy, type 1E'] |
| NM_032446.2(MEGF10): c.2320T > C (p.Cys774Arg) | 387907072 | MEGF10 | [ ] | ['GGGCAGYGTACTTGCCGCACTGG'] | ['Myopathy, areflexia, respiratory distress, and dysphagia, early-onset', 'Myopathy, areflexia, respiratory distress, and dysphagia, early-onset, mild variant'] |
| NM_005502.3(ABCA1): c.4429T > C (p.Cys1477Arg) | 137854494 | ABCA1 | ['CCTGTGYGTCCCCCAGGGGCAGG', 'CTGTGYGTCCCCAGGGGCAGGG', 'TGTGYGTCCCCAGGGGCAGGGG', 'GTGYGTCCCCAGGGGCAGGGGG'] | ['CCTGTGYGTCCCCAGGGGCAGG', 'CTGTGYGTCCCCAGGGGCAGGG', 'TGTGYGTCCCCAGGGGCAGGGG', 'GTGYGTCCCCAGGGGCAGGGGG'] | ['Tangier disease'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| | | | GGGCAGGG'] | | |
| NM_005502.3(ABCA1): c.6026T > C (p.Phe2009Ser) | 137854499 | ABCA1 | [ ] | ['GAGTYCTTTGCCCTTTTGAGAGG'] | ['Familial hypoalphalipoproteinemia'] |
| NM_015175.2(NBEAL2): c.1163T > C (p.Leu388Pro) | 387907113 | NBEAL2 | [ ] | [ ] | ['Gray platelet syndrome'] |
| NM_000196.3(HSD11B2): c.1012T > C (p.Tyr338His) | 387907117 | HSD11B2 | [ ] | ['CCGCCGCYATTACCCCGGCCAGG', 'CGCCGCYATTACCCCGGCCAGGG'] | ['Apparent mineralocorticoid excess'] |
| NM_024599.5(RHBDF2): c.557T > C (p.Ile186Thr) | 387907129 | RHBDF2 | ['AGAYTGTGGATCCGCTGGCCCGG'] | ['AGAYTGTGGATCCGCTGGCCCGG'] | ['Howel-Evans syndrome'] |
| NM_001077488.3(GNAS): c.299T > C (p.Leu100Pro) | 137854531 | GNAS | [ ] | [ ] | ['Pseudohypoparathyroidism type 1A'] |
| NM_001256714.1(DNAAF3): c.386T > C (p.Leu129Pro) | 387907151 | DNAAF3 | [ ] | [ ] | ['Kartagener syndrome', 'Ciliary dyskinesia, primary, 2'] |
| NM_020894.2(UVSSA): c.94T > C (p.Cys32Arg) | 387907164 | UVSSA | ['AAAATTYGCAAGTATGTCTTAGG'] | ['AAAATTYGCAAGTATGTCTTAGG', 'AAAATTYGCAAGTATGTCTTAGGG'] | ['UV-sensitive syndrome 3'] |
| NM_000267.3(NF1): c.1523T > C (p.Leu508Pro) | 137854558 | NF1 | [ ] | [ ] | ['Neurofibromatosis, type 1'] |
| NM_000267.3(NF1): c.6200T > C (p.Leu2067Pro) | 137854561 | NF1 | [ ] | [ ] | ['Neurofibromatosis, familial spinal'] |
| NM_004453.3(ETFDH): c.1130T > C (p.Leu377Pro) | 387907170 | ETFDH | [ ] | ['CCAAAACYCACCTTTCCTGGTGG'] | [ ] |
| NM_000267.3(NF1): c.1070T > C (p.Leu357Pro) | 137854563 | NF1 | [ ] | [ ] | ['Neurofibromatosis, type 1', 'Neurofibromatosis, familial spinal'] |
| NM_024306.4(FA2H): c.707T > C (p.Phe236Ser) | 387907172 | FA2H | [ ] | [ ] | ['Spastic paraplegia 35'] |
| NM_001004127.2(ALG11): c.1142T > C (p.Leu381Ser) | 387907182 | — | [ ] | [ ] | ['Congenital disorder of glycosylation type 1P'] |
| NM_021167.4(GATAD1): c.304T > C (p.Ser102Pro) | 387907188 | GATAD1 | [ ] | [ ] | ['Cardiomyopathy, dilated, 2b'] |
| NM_033360.3(KRAS): c.211T > C (p.Tyr71His) | 387907205 | KRAS | [ ] | ['GGACCAGYACATGAGGACTGGGG', 'CCAGYACATGAGGACTGGGGAGG', 'CAGYACATGAGGACTGGGGAGGG'] | ['Cardiofaciocutaneous syndrome 2'] |
| NM_006265.2(RAD21): c.1753T > C (p.Cys585Arg) | 387907213 | — | [ ] | [ ] | ['Cornelia de Lange syndrome 4'] |
| NM_000222.2(KIT): c.1859T > C (p.Val620Ala) | 387907217 | KIT | [ ] | [ ] | [ ] |
| NM_000335.4(SCN5A): c.5380T > C (p.Tyr1794His) | 137854615 | SCN5A | [ ] | [ ] | ['Brugada syndrome', 'Brugada syndrome 1'] |
| NM_000076.2(CDKN1C): c.827T > C (p.Phe276Ser) | 387907224 | CDKN1C | [ ] | [ ] | ['Intrauterine growth retardation, metaphyseal dysplasia, adrenal hypoplasia congenita, and genital anomalies'] |

TABLE 7-continued

Human gene mutations that may be corrected by changing a cytosine (C) to a thymine (T). The gene name, gene symbol, and dbSNP database reference number (RS#) are indicated. Also indicated are exemplary protospacers with their PAM sequences (gRNAs and gRNAall) and the base to be edited, e.g., a C, indicated by a "Y". The "gRNAs" sequences, from top to bottom, correspond to SEQ ID NOs: 1914-2090. The "gRNA all" sequences, from top to bottom, correspond to SEQ ID NOs: 2091-2539, 3144-3333.

| Name | RS# (dbSNP) | GeneSymbol | gRNAs | gRNAall | Phenotypes |
|---|---|---|---|---|---|
| NM_005691.3(ABCC9): c.3058T > C (p.Ser1020Pro) | 387907229 | ABCC9 | [ ] | [ ] | ['Hypertrichotic osteochondrodysplasia'] |
| NM_012343.3(NNT): c.2930T > C (p.Leu977Pro) | 387907233 | NNT | [ ] | [ ] | ['Glucocorticoid deficiency 4'] |
| NM_024110.4(CARD14): c.467T > C (p.Leu156Pro) | 387907240 | CARD14 | [ ] | ['CAGCAGCYGCA GGAGCACCTGGG'] | ['Pityriasis rubra pilaris'] |
| NM_002501.3(NFIX): c.179T > C (p.Leu60Pro) | 387907254 | NFIX | [ ] | [ ] | ['Sotos syndrome 2'] |
| NM_001165963.1(SCN1A): c.121A > T (p.Lys41Ter) | 764444350 | SCN1A | [ ] | [ ] | ['Severe myoclonic epilepsy in infancy'] |
| NM_005022.3(PFN1): c.341T > C (p.Met114Thr) | 387907265 | PFN1 | [ ] | [ ] | ['Amyotrophic lateral sclerosis 18'] |
| NM_001172567.1(MYD88): c.818T > C (p.Leu273Pro) | 387907272 | MYD88 | [ ] | [ ] | ['Macroglobulinemia, waldenstrom, somatic'] |
| NM_152296.4(ATP1A3): c.2431T > C (p.Ser811Pro) | 387907282 | ATP1A3 | [ ] | ['TGCCATCYCACT GGCGTACGAGG'] | ['Alternating hemiplegia of childhood 2'] |
| NM_022787.3(NMNAT1): c.838T > C (p.Ter280Gln) | 387907290 | NMNAT1 | [ ] | [ ] | ['Leber congenital amaurosis 9'] |
| NM_005120.2(MED12): c.3493T > C (p.Ser1165Pro) | 387907361 | MED12 | [ ] | ['AGGACYCTGAG CCAGGGGCCCGG'] | ['Ohdo syndrome, X-linked'] |
| NM_006194.3(PAX9): c.62T > C (p.Leu21Pro) | 28933970 | PAX9 | [ ] | ['GGCCGCYGCCC AACGCCATCCGG'] | ['Tooth agenesis, selective, 3'] |
| NM_000492.3(CFTR): c.2780T > C (p.Leu927Pro) | 397508435 | CFTR | [ ] | [ ] | ['Cystic fibrosis'] |
| NM_177976.2(ARL6): c.272T > C (p.Ile91Thr) | 137854907 | ARL6 | [ ] | [ ] | ['Bardet-Biedl syndrome'] |

TABLE 8

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000138.4 (FBN1):c.3128A>G (p.Lys1043Arg) | 137854472 | FBN1 | [ ] | ['TGCACYTGCCGT GGGTGCAGAGG'] | [ ] |
| NM_000237.2 (LPL):c.953A>G (p.Asn318Ser) | 268 | LPL | [ ] | [ ] | ['Hyperlipidemia, familial combined'] |
| NM_000257.3 (MYH7):c.2708A>G (p.Glu903Gly) | 727504261 | MYH7 | [ ] | ['AGCGCYCCTCAG CATCTGCCAGG'] | ['Cardiomyopathy', 'not specified'] |
| NM_000059.3 (BRCA2):c.476-2A>G | 81002853 | BRCA2 | [ ] | ['ACCACYGGGGG TAAAAAAAGGGG', 'TACCACYGGGGG TAAAAAAAGGG', 'ATACCACYGGGG GTAAAAAAAGG'] | ['Familial cancer of breast', 'Breast-ovarian cancer, familial 2', 'Hereditary cancer-predisposing syndrome'] |
| NM_000059.3 (BRCA2):c.9118-2A>G | 81002862 | BRCA2 | [ ] | [ ] | ['Familial cancer of breast', 'Breast-ovarian cancer, familial 2'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000059.3 (BRCA2):c.9649-2A>G | 81002895 | BRCA2 | [ ] | [ ] | ['Familial cancer of breast', 'Breast-ovarian cancer, familial 2'] |
| NM_000387.5 (SLC25A20):c.713A>G (p.Gln238Arg) | 28934589 | SLC25A20 | [ ] | [ ] | ['Carnitine acylcarnitine translocase deficiency', 'not provided'] |
| NM_000060.3 (BTD):c.755A>G (p.Asp252Gly) | 28934601 | BTD | [ ] | [ ] | ['Biotinidase deficiency'] |
| NM_172107.2 (KCNQ2):c.851A>G (p.Tyr284Cys) | 28939683 | KCNQ2 | [ ] | [ ] | ['Benign familial neonatal seizures 1'] |
| NM_006158.4 (NEFL):c.293A>G (p.Asn98Ser) | 58982919 | NEFL | [ ] | [ ] | ['Charcot-Marie-Tooth disease, type IF', 'not provided'] |
| NM_000019.3 (ACAT1):c.473A>G (p.Asn158Ser) | 199524907 | ACAT1 | [ ] | [ ] | ['Deficiency of acetyl-CoA acetyltransferase'] |
| NM_007294.3 (BRCA1):c.4987-2A>G | 397509212 | BRCA1 | [ ] | [ ] | ['Familial cancer of breast'] |
| NM_007294.3 (BRCA1):c.213-12A>G | 80358163 | BRCA1 | [ ] | [ ] | ['Familial cancer of breast', 'Hereditary breast and ovarian cancer syndrome', 'Breast-ovarian cancer, familial 1', 'Hereditary cancer-predisposing syndrome'] |
| NM_001382.3 (DPAGT1):c.509A>G (p.Tyr170Cys) | 28934876 | DPAGT1 | ['ACAYAGT ACAGGATT CCTGCGGG', 'GACAYAG TACAGGAT TCCTGCGG'] | ['ACAYAGTACAG GATTCCTGCGGG', 'GACAYAGTACAG GATTCCTGCGG'] | ['Congenital disorder of glycosylation type 1J'] |
| NM_032237.4 (POMK):c.773A>G (p.Gln258Arg) | 397509386 | POMK | [ ] | [ ] | ['Congenital muscular dystrophy-dystroglycanopathy with brain and eye anomalies, type A12'] |
| NM_201647.2 (STAMBP):c.125A>G (p.Glu42Gly) | 397509387 | STAMBP | [ ] | [ ] | ['Microcephaly-capillary malformation syndrome'] |
| NM_006876.2 (B4GAT1):c.1168A>G (p.Asn390Asp) | 397509397 | B4GAT1 | ['CTGATYT TCAGCCTC CTTTTGGG', 'GCTGATYT TCAGCCTC CTTTTGG'] | ['TGATYTTCAGCC TCCTTTTGGGG', 'CTGATYTTCAGC CTCCTTTTGGG', 'GCTGATYTTCAG CCTCCTTTTGG'] | ['Congenital muscular dystrophy-dystroglycanopathy with brain and eye anomalies, type A13'] |
| NM_004315.4 (ASAH1):c.965+4A>G | 397509415 | ASAH1 | [ ] | [ ] | ['Farber lipogranulomatosis'] |
| NM_000257.3 (MYH7):c.1477A>G (p.Met493Val) | 730880875 | MYH7 | [ ] | [ ] | ['Cardiomyopathy'] |
| NM_021020.3 (LZTS1):c.355A>G (p.Lys119Glu) | 119473032 | LZTS1 | [ ] | ['CCCTYCTCGGAG CCCTGTAGAGG'] | [ ] |
| NM_022455.4 (NSD1):c.5893-2A>G | 587784163 | NSD1 | [ ] | [ ] | ['Sotos syndrome 1'] |
| NM_006894.5 (FMO3):c.182A>G (p.Asn61Ser) | 72549322 | FMO3 | [ ] | [ ] | ['Trimethylaminuria'] |
| NM_000403.3 (GALE):c.101A>G (p.Asn34Ser) | 121908046 | GALE | ['TGGAAGY TATCGATG ACCACAGG'] | ['TGGAAGYTATCG ATGACCACAGG'] | ['UDPglucose-4-epimerase deficiency'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000314.6 (PTEN):c.527A>G (p.Tyr176Cys) | 757498880 | PTEN | [ ] | [ ] | ['Hereditary cancer-predisposing syndrome'] |
| NM_000053.3 (ATP7B):c.2305A>G (p.Met769Val) | 193922103 | ATP7B | [ ] | [ ] | ['Wilson disease', 'not specified', 'not provided'] |
| NM_000173.6 (GP1BA):c.763A>G (p.Met255Val) | 121908064 | GP1BA | [ ] | [ ] | ['Pseudo von Willebrand disease'] |
| NM_000422.2 (KRT17):c.275A>G (p.Asn92Ser) | 59151893 | KRT17 | ['GTCAYTG AGGTTCTG CATGGTGG'] | ['GTCAYTGAGGTT CTGCATGGTGG', 'GCGGTCAYTGAG GTTCTGCATGG'] | ['Pachyonychia congenita type 2', 'not provided'] |
| NM_000288.3 (PEX7):c.854A>G (p.His285Arg) | 62653611 | PEX7 | [ ] | [ ] | ['Rhizomelic chondrodysplasia punctata type 1'] |
| NM_003742.2 (ABCB11):c.890A>G (p.Glu297Gly) | 11568372 | ABCB11 | [ ] | [ ] | ['Progressive familial intrahepatic cholestasis 2', 'Benign recurrent intrahepatic cholestasis 2'] |
| NM_012243.2 (SLC35A3):c.886A>G (p.Ser296Gly) | 141952252 | SLC35A3 | [ ] | [ ] | ['Arthrogryposis, mental retardation, and seizures'] |
| NM_000061.2 (BTK):c.1082A>G (p.Tyr361Cys) | 28935478 | BTK | ['GATGGYA GTTAATGA GCTCAGGG', 'TGATGGY AGTTAATG AGCTCAGG'] | ['GATGGYAGTTA ATGAGCTCAGGG', 'TGATGGYAGTTA ATGAGCTCAGG'] | [ ] |
| NM_000169.2 (GLA):c.815A>G (p.Asn272Ser) | 28935495 | — | [ ] | [ ] | ['Fabry disease'] |
| NM_016069.9 (PAM16):c.226A>G (p.Asn76Asp) | 786203989 | — | ['TCATAGT YCTGCAGA GGAGAGG G'] | ['CATAGTYCTGCA GAGGAGAGGG', 'TCATAGTYCTGC AGAGGAGAGGG'] | ['Chondrodysplasia, megarbane-dagher-melki type'] |
| NM_058163.1 (TSR2):c.191A>G (p.Glu64Gly) | 786203996 | TSR2 | [ ] | [ ] | ['Diamond-Blackfan anemia with microtia and cleft palate', 'DIAMOND-BLACKFAN ANEMIA 14 WITH MANDIBULOFACIAL DYSOSTOSIS'] |
| NM_001098398.1 (COPA):c.728A>G (p.Asp243Gly) | 794727994 | — | [ ] | [ ] | [ ] |
| NM_005957.4 (MTHFR):c.1114A>G (p.Lys372Glu) | 786204024 | MTHFR | [ ] | [ ] | ['Homocysteinemia due to MTHFR deficiency'] |
| NM_012193.3 (FZD4):c.1024A>G (p.Met342Val) | 80358293 | — | [ ] | [ ] | ['Exudative vitreoretinopathy 1'] |
| NM_000186.3 (CFH):c.3590T>C (p.Val1197Ala) | 460184 | CFH | ['CAGYTGA ATTTGTGT GTAAACGG'] | ['CAGYTGAATTTG TGTGTAAACGG'] | ['Atypical hemolytic-uremic syndrome 1'] |
| NM_014846.3 (KIAA0196):c.1411A>G (p.Asn471Asp) | 80338865 | KIAA0196 | [ ] | [ ] | ['Spastic paraplegia 8'] |
| NM_014946.3 (SPAST):c.1165A>G (p.Thr389Ala) | 786204132 | SPAST | ['AGCATTG YCTTCCCA TTCCCAGG'] | ['ATTGYCTTCCCA TTCCCAGGTGG', 'AGCATTGYCTTC CCATTCCCAGG'] | ['Spastic paraplegia 4, autosomal dominant'] |
| NM_000925.3 (PDHB):c.395A>G (p.Tyr132Cys) | 28935769 | PDHB | [ ] | [ ] | ['Pyruvate dehydrogenase E1-beta deficiency'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000090.3 (COL3A1):c.2338-2A>G | 794728050 | COL3A1 | [ ] | [ ] | ['Thoracic aortic aneurysms and aortic dissections'] |
| NM_000540.2 (RYR1):c.97A>G (p.Lys33Glu) | 193922746 | RYR1 | [ ] | [ ] | ['King Denborough syndrome', 'not provided'] |
| NM_000540.2 (RYR1):c.7043A>G (p.Glu2348Gly) | 193922801 | RYR1 | [ ] | ['TTCYCCTCCACG CTCTCGCCTGG'] | ['not provided'] |
| NM_000218.2 (KCNQ1):c.652A>G (p.Lys218Glu) | 36210419 | KCNQ1 | [ ] | ['GCCCCTYGGAGC CCACGCAGAGG'] | ['Torsades de pointes', 'Cardiac arrhythmia'] |
| NM_000540.2 (RYR1):c.14647-1449A>G | 193922886 | RYR1 | [ ] | [ ] | ['Minicore myopathy with external ophthalmoplegia', 'not provided'] |
| NM_004429.4 (EFNB1):c.472A>G (p.Met158Val) | 28936071 | EFNB1 | [ ] | [ ] | ['Craniofrontonasal dysplasia'] |
| NM_007254.3 (PNKP):c.1029+2T>C | 199919568 | PNKP | ['CCGGYGA GGCCCTGG GGCGGGGG', 'TCCGGYG AGGCCCTG GGGCGGG G'] | ['CCGGYGAGGCC CTGGGGCGGGGG', 'TCCGGYGAGGCC CTGGGGCGGGG', 'ATCCGGYGAGGC CCTGGGGCGGG', 'GATCCGGYGAGG CCCTGGGGCGG'] | ['not provided'] |
| NM_005448.2 (BMP15):c.704A>G (p.Tyr235Cys) | 104894765 | BMP15 | ['ATTGAAA YAGAGTAA CAAGAAGG'] | ['ATTGAAAYAGA GTAACAAGAAGG'] | ['Ovarian dysgenesis 2'] |
| NM_004415.2 (DSP):c.1141-2A>G | 794728111 | DSP | [ ] | [ ] | ['not provided'] |
| NM_016035.4 (COQ4):c.155T>C (p.Leu52Ser) | 786204770 | COQ4 | ['GCTGTYG GCCGCCGG CTCCGCGG'] | ['GCTGTYGGCCGC CGGCTCCGCGG'] | ['COENZYME Q10 DEFICIENCY, PRIMARY, 7'] |
| NM_015717.4 (CD207):c.790T>C (p.Trp264Arg) | 200837270 | CD207 | [ ] | [ ] | ['Birbeck granule deficiency'] |
| NM_004771.3 (MMP20):c.611A>G (p.His204Arg) | 786204826 | MMP20 | ['CGAAAYG TGTATCTC CTCCCAGG'] | ['CGAAAYGTGTAT CTCCTCCCAGG'] | ['Amelogenesis imperfecta, hypomaturation type, IIA2'] |
| NM_003392.4 (WNT5A):c.257A>G (p.Tyr86Cys) | 786204836 | WNT5A | [ ] | [ ] | ['Robinow syndrome'] |
| NM_000918.3 (P4HB):c.1178A>G (p.Tyr393Cys) | 786204843 | P4HB | [ ] | [ ] | ['Cole Carpenter syndrome'] |
| NM_000314.6 (PTEN):c.139A>G (p.Arg47Gly) | 786204855 | PTEN | [ ] | [ ] | ['Hereditary cancer-predisposing syndrome'] |
| NM_000314.6 (PTEN):c.320A>G (p.Asp107Gly) | 786204858 | PTEN | [ ] | [ ] | ['Hereditary cancer-predisposing syndrome'] |
| NM_000447.2 (PSEN2):c.715A>G (p.Met239Val) | 28936379 | PSEN2 | [ ] | [ ] | ['Alzheimer disease, type 4', 'not provided'] |
| NM_005263.3 (GFI1):c.1145A>G (p.Asn382Ser) | 28936381 | GFI1 | [ ] | [ ] | ['Severe congenital neutropenia 2, autosomal dominant'] |
| NM_005263.3 (GFI1):c.1208A>G (p.Lys403Arg) | 28936382 | GFI1 | [ ] | [ ] | ['Neutropenia, nonimmune chronic idiopathic, of adults'] |
| NM_000314.6 (PTEN):c.512A>G (p.Gln171Arg) | 786204865 | PTEN | [ ] | [ ] | ['Hereditary cancer-predisposing syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000314.6 (PTEN):c.254-2A>G | 786204926 | PTEN | [ ] | [ ] | ['Hereditary cancer-predisposing syndrome'] |
| NM_001103.3 (ACTN2):c.1883A>G (p.Glu628Gly) | 786204951 | ACTN2 | [ ] | [ ] | ['Familial hypertrophic cardiomyopathy 23'] |
| NM_003159.2 (CDKL5):c.-162-2A>G | 786204973 | CDKL5 | [ ] | [ ] | ['Early infantile epileptic encephalopathy 2'] |
| NM_001159287.1 (TPI1):c.622A>G (p.Ile208Val) | 121964849 | TPI1 | [ ] | [ ] | ['Triosephosphate isomerase deficiency'] |
| NM_003159.2 (CDKL5):c.2277-2A>G | 786204979 | CDKL5 | [ ] | [ ] | ['Early infantile epileptic encephalopathy 2'] |
| NM_003159.2 (CDKL5):c.458A>G (p.Asp153Gly) | 786204985 | CDKL5 | [ ] | [ ] | ['Early infantile epileptic encephalopathy 2'] |
| NM_003159.2 (CDKL5):c.91A>G (p.Arg31Gly) | 786204991 | CDKL5 | [ ] | [ ] | ['Early infantile epileptic encephalopathy 2'] |
| NM_001007792.1 (NTRK1):c.986A>G (p.Tyr329Cys) | 121964869 | NTRK1 | [ ] | [ ] | ['Hereditary insensitivity to pain with anhidrosis'] |
| NM_001007792.1 (NTRK1):c.1651A>G (p.Met551Val) | 121964870 | NTRK1 | [ ] | [ ] | ['Hereditary insensitivity to pain with anhidrosis'] |
| NM_004360.3 (CDH1):c.2512A>G (p.Ser838Gly) | 121964872 | CDH1 | [ ] | [ ] | ['Hereditary diffuse gastric cancer', 'Hereditary cancer-predisposing syndrome', 'Neoplasm of ovary'] |
| NM_003122.4 (SPINK1):c.101A>G (p.Asn34Ser) | 17107315 | SPINK1 | [ ] | [ ] | ['Hereditary pancreatitis', 'Tropical calcific pancreatitis', 'Pancreatitis, chronic, susceptibility to'] |
| NM_021098.2 (CACNA1H):c.4645A>G (p.Met1549Val) | 786205050 | CACNA1H | [ ] | [ ] | ['Primary hyperaldosteronism'] |
| NM_001385.2 (DPYS):c.1001A>G (p.Gln334Arg) | 121964923 | DPYS | [ ] | [ ] | ['Dihydropyrimidinase deficiency'] |
| NM_003494.3 (DYSF):c.3443-33A>G | 786205083 | DYSF | ['GCCAGAG YGAGTGGC TGGAGTGG'] | ['GCCAGAGYGAG TGGCTGGAGTGG'] | ['Limb-girdle muscular dystrophy, type 2B'] |
| NM_003816.2 (ADAM9):c.411-8A>G | 786205086 | ADAM9 | [ ] | [ ] | [ ] |
| NM_000532.4 (PCCB):c.1304A>G (p.Tyr435Cys) | 121964961 | PCCB | [ ] | [ ] | ['Propionic acidemia'] |
| NM_000071.2 (CBS):c.1150A>G (p.Lys384Glu) | 121964967 | CBS | ['AACTYGG TCCTGCGG GATGGGGG'] | ['AACTYGGTCCTG CGGGATGGGGG', 'GAACTYGGTCCT GCGGGATGGGG', 'GGAACTYGGTCC TGCGGGATGGG', 'AGGAACTYGGTC CTGCGGGATGG'] | ['Homocystinuria, pyridoxine-responsive'] |
| NM_000093.4 (COL5A1):c.655-2A>G | 786205101 | COL5A1 | [ ] | [ ] | ['Ehlers-Danlos syndrome, classic type'] |
| NM_000481.3 (AMT):c.125A>G (p.His42Arg) | 121964983 | AMT | ['GCCAGGY GGAAGTCA TAGAGCGG'] | ['GCCAGGYGGAA GTCATAGAGCGG'] | ['Non-ketotic hyperglycinemia'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000108.4 (DLD):c.214A>G (p.Lys72Glu) | 121964987 | DLD | [ ] | [ ] | ['Maple syrup urine disease, type 3'] |
| NM_000108.4 (DLD):c.1483A>G (p.Arg495Gly) | 121964989 | DLD | [ ] | ['TTCTCYAAAAGC TTCTGATAAGG'] | ['Maple syrup urine disease, type 3'] |
| NM_000108.4 (DLD):c.1081A>G (p.Met361Val) | 121964993 | DLD | [ ] | [ ] | ['Maple syrup urine disease, type 3'] |
| NM_001918.3 (DBT):c.1355A>G (p.His452Arg) | 121965002 | DBT | [ ] | [ ] | [ ] |
| NM_030813.5 (CLPB):c.1850A>G (p.Tyr617Cys) | 786205138 | CLPB | [ ] | [ ] | [3-METHYLGLUTACONIC ACIDURIA WITH CATARACTS, NEUROLOGIC INVOLVEMENT, AND NEUTROPENIA'] |
| NM_006610.3 (MASP2):c.359A>G (p.Asp120Gly) | 72550870 | MASP2 | [ ] | [ ] | ['MASP2 deficiency'] |
| NM_000398.6 (CYB5R3):c.719A>G (p.Asp240Gly) | 121965018 | CYB5R3 | [ ] | [ ] | ['METHEMO-GLOBINEMIA, TYPE I'] |
| NM_000095.2 (COMP):c.1358A>G (p.Asn453Ser) | 28936668 | COMP | [ ] | [ ] | [ ] |
| NM_000095.2 (COMP):c.1418A>G (p.Asp473Gly) | 28936669 | COMP | [ ] | ['ATTGYCGTCGTC GTCGTCGCAGG'] | [ ] |
| NM_003816.2 (ADAM9):c.1396-2A>G | 786205151 | ADAM9 | [ ] | [ ] | [ ] |
| NM_001204830.1 (LIPT1):c.535A>G (p.Thr179Ala) | 786205156 | — | [ ] | [ ] | ['LIPOYL-TRANSFERASE 1 DEFICIENCY'] |
| NM_000274.3 (OAT):c.734A>G (p.Tyr245Cys) | 121965046 | OAT | [ ] | [ ] | ['Ornithine aminotransferase deficiency'] |
| NM_018488.2 (TBX4):c.1592A>G (p.Gln531Arg) | 28936696 | TBX4 | [ ] | ['GTACYGTAAGG AAGATTCTCGGG', 'GGTACYGTAAGG AAGATTCTCGG'] | ['Ischiopatellar dysplasia'] |
| NM_001110556.1 (FLNA):c.1829-2A>G | 786205183 | FLNA | [ ] | [ ] | ['X-linked periventricular heterotopia'] |
| NM_003865.2 (HESX1):c.541A>G (p.Thr181Ala) | 28936704 | HESX1 | [ ] | [ ] | ['Growth hormone deficiency with pituitary anomalies'] |
| NM_000137.2 (FAH):c.1141A>G (p.Arg381Gly) | 121965077 | FAH | [ ] | ['TCCYGGTCTGAC CATTCCCCAGG'] | ['Tyrosinemia type I'] |
| NM_000137.2 (FAH):c.836A>G (p.Gln279Arg) | 121965078 | FAH | [ ] | [ ] | ['Tyrosinemia type I'] |
| NM_006129.4 (BMP1):c.808A>G (p.Met270Val) | 786205219 | BMP1 | [ ] | [ ] | ['Osteogenesis imperfecta type 13'] |
| NM_001987.4 (ETV6):c.1252A>G (p.Arg418Gly) | 786205226 | ETV6 | [ ] | [ ] | ['Thrombocytopenia 5'] |
| NM_014423.3 (AFF4):c.760A>G (p.Thr254Ala) | 786205233 | AFF4 | [ ] | [ ] | ['CHOPS SYNDROME'] |
| NM_000140.3 (FECH):c.68_194del | 786205247 | FECH | [ ] | [ ] | ['Erythropoietic protoporphyria'] |
| NM_000138.4 | 794728203 | FBN1 | [ ] | ['ACTCAYCAATAT | ['Thoracic aortic |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (FBN1):c.3344A>G (p.Asp1115Gly) | | | | CTGCAAAATGG'] | aneurysms and aortic dissections'] |
| NM_198270.3 (NHS):c.853-2A>G | 786205257 | NHS | [ ] | [ ] | ['Nance-Horan syndrome'] |
| NM_005502.3 (ABCA1):c.1790A>G (p.Gln597Arg) | 2853578 | ABCA1 | [ ] | [ ] | ['Tangier disease'] |
| NM_003002.3 (SDHD):c.275A>G (p.Asp92Gly) | 786205436 | SDHD | [ ] | ['GAATAGYCCATC GCAGAGCAAGG'] | ['Fatal infantile mitochondrial cardiomyopathy'] |
| NM_005259.2 (MSTN):c.458A>G (p.Lys153Arg) | 1805086 | — | [ ] | [ ] | [ ] |
| NM_198056.2 (SCN5A):c.1673A>G (p.His558Arg) | 1805124 | SCN5A | [ ] | [ ] | ['Progressive familial heart block type 1A', 'not specified', 'not provided'] |
| NM_000784.3 (CYP27A1):c.776A>G (p.Lys259Arg) | 72551317 | CYP27A1 | [ ] | ['AGTCCACYTGGG GAGGAAGGTGG'] | ['Cholestanol storage disease'] |
| NM_000784.3 (CYP27A1):c.1061A>G (p.Asp354Gly) | 72551320 | CYP27A1 | [ ] | [ ] | ['Cholestanol storage disease'] |
| NM_000463.2 (UGT1A1):c.992A>G (p.Gln331Arg) | 72551348 | — | [ ] | [ ] | ['Crigler-Najjar syndrome, type II'] |
| NM_000463.2 (UGT1A1):c.1070A>G (p.Gln357Arg) | 72551351 | — | [ ] | [ ] | ['Crigler Najjar syndrome, type 1'] |
| NM_016218.2 (POLK):c.1385A>G (p.Asn462Ser) | 786205687 | POLK | [ ] | ['ATTCACAYTCTT CAACTTAATGG'] | ['Malignant tumor of prostate'] |
| NM_016218.2 (POLK):c.181A>G (p.Asn61Asp) | 786205689 | POLK | [ ] | [ ] | ['Malignant tumor of prostate'] |
| NM_016218.2 (POLK):c.1477A>G (p.Lys493Glu) | 786205692 | POLK | [ ] | [ ] | ['Malignant tumor of prostate'] |
| NM_000138.4 (FBN1):c.7916A>G (p.Tyr2639Cys) | 794728280 | FBN1 | [ ] | ['TGTTCAYACTGG AAGCCGGCGGG', 'CTGTTCAYACTG GAAGCCGGCGG'] | ['Thoracic aortic aneurysms and aortic dissections'] |
| NM_000132.3 (F8):c.1331A>G (p.Lys444Arg) | 28937272 | F8 | [ ] | [ ] | ['Hereditary factor VIII deficiency disease'] |
| NM_000531.5 (OTC):c.268A>G (p.Ser90Gly) | 72554340 | OTC | [ ] | [ ] | ['not provided'] |
| NM_005502.3 (ABCA1):c.2804A>G (p.Asn935Ser) | 28937313 | ABCA1 | ['TCCAYTG TGGCCCAG GAAGGAG G'] | ['TCCAYTGTGGCC CAGGAAGGAGG', 'CGCTCCAYTGTG GCCCAGGAAGG'] | ['Tangier disease'] |
| NM_004380.2 (CREBBP):c.3524A>G (p.Tyr1175Cys) | 28937315 | CREBBP | [ ] | [ ] | ['Rubinstein-Taybi syndrome'] |
| NM_000335.4 (SCN5A):c.3971A>G (p.Asn1324Ser) | 28937317 | SCN5A | [ ] | ['GCAYTGACCACC ACCTCAAGTGG'] | ['Long QT syndrome 3', 'Congenital long QT syndrome'] |
| NM_000891.2 (KCNJ2):c.901A>G (p.Met301Val) | 786205818 | KCNJ2 | [ ] | [ ] | ['Cardiac arrhythmia'] |
| NM_144499.2 (GNAT1):c.386A>G (p.Asp129Gly) | 786205854 | GNAT1 | [ ] | ['CGGAGYCCTTCC ACAGCCGCTGG'] | ['NIGHT BLINDNESS, CONGENITAL STATIONARY, TYPE 1G'] |
| NM_000523.3 (HOXD13):c.974A>G (p.Gln325Arg) | 104893635 | HOXD13 | [ ] | [ ] | ['Syndactyly type 5'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_013953.3 (PAX8):c.160A>G (p.Ser54Gly) | 104893660 | — | [ ] | [ ] | ['Thyroid agenesis'] |
| NM_014585.5 (SLC40A1):c.470A>G (p.Asp157Gly) | 104893663 | SLC40A1 | [ ] | [ ] | ['Hemochromatosis type 4'] |
| NM_003124.4 (SPR):c.448A>G (p.Arg150Gly) | 104893665 | SPR | [ ] | [ ] | ['Sepiapterin reductase deficiency'] |
| NM_000258.2 (MYL3):c.445A>G (p.Met149Val) | 104893748 | MYL3 | [ ] | [ ] | ['Familial hypertrophic cardiomyopathy 8', 'Cardiomyopathy', 'Hypertrophic cardiomyopathy'] |
| NM_000539.3 (RHO):c.533A>G (p.Tyr178Cys) | 104893776 | RHO | [ ] | ['GGATGYACCTG AGGACAGGCAGG'] | ['Retinitis pigmentosa 4'] |
| NM_000539.3 (RHO):c.569A>G (p.Asp190Gly) | 104893777 | RHO | [ ] | [ ] | ['Retinitis pigmentosa 4'] |
| NM_000539.3 (RHO):c.44A>G (p.Asn15Ser) | 104893786 | RHO | [ ] | [ ] | ['Retinitis pigmentosa', 'Retinitis pigmentosa 4'] |
| NM_001814.4 (CTSC):c.1235A>G (p.Tyr412Cys) | 28937571 | CTSC | [ ] | [ ] | ['Periodontitis, aggressive, 1'] |
| NM_001701.3 (BAAT):c.226A>G (p.Met76Val) | 28937579 | BAAT | [ ] | [ ] | ['Hypercholanemia, familial'] |
| NM_001257342.1 (BCS1L):c.232A>G (p.Ser78Gly) | 28937590 | BCS1L | [ ] | ['GACACYGAGGT GCTGAGTACGGG', 'CGACACYGAGGT GCTGAGTACGG'] | ['GRACILE syndrome'] |
| NM_004407.3 (DMP1):c.1A>G (p.Met1Val) | 104893834 | DMP1 | [ ] | [ ] | ['Autosomal recessive hypophosphatemic vitamin D refractory rickets'] |
| NM_000406.2 (GNRHR):c.317A>G (p.Gln106Arg) | 104893836 | GNRHR | [ ] | [ ] | ['Hypogonadotropic hypogonadism'] |
| NM_172250.2 (MMAA):c.620A>G (p.Tyr207Cys) | 104893849 | MMAA | [ ] | [ ] | ['Methylmalonic aciduria cblA type'] |
| NM_000320.2 (QDPR):c.449A>G (p.Tyr150Cys) | 104893866 | QDPR | [ ] | ['TGCCGYACCCGA TCATACCTGGG', 'ATGCCGYACCCG ATCATACCTGG'] | ['Dihydropteridine reductase deficiency'] |
| NM_015629.3 (PRPF31):c.527+3A>G | 587776590 | PRPF31 | [ ] | ['GACAYACCCCTG GGTGGTGGAGG', 'GCGGACAYACCC CTGGGTGGTGG'] | ['Retinitis pigmentosa 11'] |
| NM_000112.3 (SLC26A2):c.1273A>G (p.Asn425Asp) | 104893920 | SLC26A2 | [ ] | [ ] | ['Diastrophic dysplasia', 'Achondrogenesis, type IB'] |
| NM_000344.3 (SMN1):c.815A>G (p.Tyr272Cys) | 104893922 | SMN1 | [ ] | [ ] | ['Werdnig-Hoffmann disease'] |
| NM_000344.3 (SMN1):c.784A>G (p.Ser262Gly) | 104893932 | SMN1 | [ ] | [ ] | ['Kugelberg-Welander disease'] |
| NM_000409.3 (GUCA1A):c.296A>G (p.Tyr99Cys) | 104893967 | GUCA1A | [ ] | [ ] | ['Cone dystrophy 3'] |
| NM_182548.3 (LHFPL5):c.380A>G (p.Tyr127Cys) | 104893975 | LHFPL5 | [ ] | [ ] | ['Deafness, autosomal recessive 67'] |

TABLE 8-continued

Human gene mutations that may be corrected by changing a guanine (G) to an
adenine (A). The gene name, gene symbol, and dbSNP database reference number (RS#) are
indicated. Also indicated are exemplary protospacers with their PAM sequences (gRNAs and
gRNAall) and the base to be edited e.g., a C, indicated by a "Y". The "gRNAs" sequences,
from top to bottom, correspond to SEQ ID NOs: 3334-3501. The "gRNA all" sequences,
from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001024630.3 (RUNX2):c.598A>G (p.Thr200Ala) | 104893993 | RUNX2 | [ ] | [ ] | ['Cleidocranial dysostosis', 'Cleidocranial dysplasia, forme fruste, dental anomalies only'] |
| NM_000162.3 (GCK):c.641A>G (p.Tyr214Cys) | 104894015 | GCK | [ ] | ['GTAGYAGCAGG AGATCATCGTGG'] | ['Hyperinsulinemic hypoglycemia familial 3'] |
| NM_001002010.2 (NT5C3A):c.686A>G (p.Asn229Ser) | 104894028 | NT5C3A | [ ] | [ ] | ['Uridine 5-prime monophosphate hydrolase deficiency, hemolytic anemia due to'] |
| NM_203288.1 (RP9):c.509A>G (p.Asp170Gly) | 104894039 | RP9 | [ ] | [ ] | ['Retinitis pigmentosa 9'] |
| NM_000474.3 (TWIST1):c.466A>G (p.Ile156Val) | 104894059 | TWIST1 | [ ] | [ ] | ['Saethre-Chotzen syndrome'] |
| NM_000532.4 (PCCB):c.1606A>G (p.Asn536Asp) | 202247823 | PCCB | [ ] | ['ATATYTGCATGT TTTCTCCAAGG'] | ['Propionic acidemia', 'not provided'] |
| NM_021615.4 (CHST6):c.521A>G (p.Lys174Arg) | 28937877 | CHST6 | [ ] | [ ] | ['Macular corneal dystrophy Type I'] |
| NM_178138.4 (LHX3):c.332A>G (p.Tyr111Cys) | 104894117 | LHX3 | ['CAGGTGG YACACGAA GTCCTGGG'] | ['CAGGTGGYACA CGAAGTCCTGGG'] | ['Pituitary hormone deficiency, combined 3'] |
| NM_004897.4 (MINPP1):c.809A>G (p.Gln270Arg) | 104894171 | MINPP1 | [ ] | [ ] | ['Thyroid cancer, follicular'] |
| NM_000073.2 (CD3G):c.1A>G (p.Met1Val) | 104894199 | CD3G | [ ] | ['CCAYGTCAGTCT CTGTCCTCCGG'] | ['Immunodeficiency 17'] |
| NM_001885.2 (CRYAB):c.358A>G (p.Arg120Gly) | 104894201 | CRYAB | [ ] | [ ] | ['Alpha-B crystallinopathy'] |
| NM_001814.4 (CTSC):c.857A>G (p.Gln286Arg) | 104894208 | CTSC | [ ] | ['CTCCYGAGGGCT TAGGATTGGGG', 'CCTCCYGAGGGC TTAGGATTGGG', 'ACCTCCYGAGGG CTTAGGATTGG'] | ['Papillon-Lef\xc3\xa8vre syndrome', 'Haim-Munk syndrome'] |
| NM_001814.4 (CTSC):c.1040A>G (p.Tyr347Cys) | 104894211 | CTSC | [ ] | ['TCCTACAYAGTG GTACTCAGAGG'] | ['Papillon-Lef\xc3\xa8vre syndrome', 'Periodontitis, aggressive, 1'] |
| NM_012193.3 (FZD4):c.766A>G (p.Ile256Val) | 104894223 | — | ['GAAATAY GATGGGGC GCTCAGGG', 'AGAAATA YGATGGGG CGCTCAGG'] | ['GAAATAYGATG GGGCGCTCAGGG', 'AGAAATAYGATG GGGCGCTCAGG'] | ['Retinopathy of prematurity'] |
| NM_005343.2 (HRAS):c.350A>G (p.Lys117Arg) | 104894227 | — | [ ] | [ ] | ['Costello syndrome'] |
| NM_145014.2 (HYLS1):c.632A>G (p.Asp211Gly) | 104894232 | — | [ ] | [ ] | ['Hydrolethalus syndrome'] |
| NM_000525.3 (KCNJ11):c.776A>G (p.His259Arg) | 104894248 | KCNJ11 | ['GACAYGG TAGATGAT CAGCGGGG'] | ['GACAYGGTAGA TGATCAGCGGGG', 'TGACAYGGTAGA TGATCAGCGGG', 'ATGACAYGGTAG ATGATCAGCGG'] | ['Islet cell hyperplasia'] |
| NM_000317.2 (PTS):c.155A>G | 104894275 | PTS | ['TAAYTGT GCCCATGG | ['TAAYTGTGCCCA TGGCCATTTGG'] | ['6-pyruvoyl-tetrahydropterin |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (p.Asn52Ser) | | | CCATTTGG'] | | synthase deficiency'] |
| NM_000317.2 (PTS):c.139A>G (p.Asn47Asp) | 104894278 | PTS | [ ] | [ ] | ['Hyperphenyl-alaninemia, bh4-deficient, a, due to partial pts deficiency'] |
| NM_000317.2 (PTS):c.347A>G (p.Asp116Gly) | 104894279 | PTS | [ ] | [ ] | ['Hyperphenyl-alaninemia, bh4-deficient, a, due to partial pts deficiency'] |
| NM_022051.2 (EGLN1):c.1121A>G (p.His374Arg) | 119476045 | EGLN1 | [ ] | [ ] | ['Erythrocytosis, familial, 3'] |
| NM_015915.4 (ATL1):c.773A>G (p.His258Arg) | 119476048 | ATL1 | [ ] | [ ] | ['Spastic paraplegia 3'] |
| NM_000448.2 (RAG1):c.2735A>G (p.Tyr912Cys) | 104894290 | RAG1 | [ ] | ['CTGYACTGGCAG AGGGATTCTGG'] | ['Histiocytic medullary reticulosis'] |
| NM_000448.2 (RAG1):c.1286A>G (p.Asp429Gly) | 104894292 | RAG1 | [ ] | [ ] | ['Histiocytic medullary reticulosis'] |
| NM_003002.3 (SDHD):c.341A>G (p.Tyr114Cys) | 104894304 | SDHD | [ ] | [ ] | ['Hereditary Paraganglioma-Pheochromocytoma Syndromes', 'Paragangliomas 1'] |
| NM_015141.3 (GPD1L):c.370A>G (p.Ile124Val) | 72552293 | GPD1L | [ ] | [ ] | ['Brugada syndrome 2', 'Primary familial hypertrophic cardiomyopathy', 'Long QT syndrome', 'Sudden infant death syndrome', 'Cardiomyopathy'] |
| NM_020661.2A (AICDA):c.415A>G (p.Met139Val) | 104894322 | AICDA | [ ] | [ ] | ['Immunodeficiency with hyper IgM type 2'] |
| NM_014365.2 (HSPB8):c.421A>G (p.Lys141Glu) | 104894351 | HSPB8 | [ ] | [ ] | ['Charcot-Marie-Tooth disease', 'Distal hereditary motor neuronopathy type 2A'] |
| NM_000217.2 (KCNA1):c.676A>G (p.Thr226Ala) | 104894354 | KCNA1 | [ ] | ['GCGYTTCCACGA TGAAGAAGGGG', 'AGCGYTTCCACG ATGAAGAAGGG', 'CAGCGYTTCCAC GATGAAGAAGG'] | ['Episodic ataxia type 1'] |
| NM_014239.3 (EIF2B2):c.638A>G (p.Glu213Gly) | 104894425 | EIF2B2 | [ ] | ['AGTTGTCYCAAT ACCTGCTTTGG'] | ['Leukoencephalopathy with vanishing white matter', 'Ovarioleuko-dystrophy'] |
| NM_002408.3 (MGAT2):c.785A>G (p.His262Arg) | 104894447 | MGAT2 | [ ] | [ ] | ['Carbohydrate-deficient glycoprotein syndrome type II'] |
| NM_002408.3 (MGAT2):c.952A>G (p.Asn318Asp) | 104894448 | MGAT2 | [ ] | [ ] | ['Carbohydrate-deficient glycoprotein syndrome type II'] |
| NM_000270.3 (PNP):c.383A>G (p.Asp128Gly) | 104894450 | PNP | [ ] | ['ATAYCTCCAACC TCAAACTTGGG', 'GATAYCTCCAAC CTCAAACTTGG'] | ['Purine-nucleoside phosphorylase deficiency'] |
| NM_000270.3 (PNP):c.575A>G (p.Tyr192Cys) | 104894452 | PNP | [ ] | [ ] | ['Purine-nucleoside phosphorylase deficiency'] |
| NM_005982.3 | 104894478 | SIX1 | [ ] | [ ] | ['Melnick-Fraser |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (SIX1):c.386A>G (p.Tyr129Cys) | | | | | syndrome', 'Branchiootic syndrome 3'] |
| NM_000101.3 (CYBA):c.281A>G (p.His94Arg) | 104894510 | CYBA | [ ] | [ ] | ['Granulomatous disease, chronic, autosomal recessive, cytochrome b-negative'] |
| NM_024887.3 (DHDDS):c.124A>G (p.Lys42Glu) | 147394623 | DHDDS | [ ] | ['GGCACTYCTTGG CATAGCGACGG'] | ['Retinitis pigmentosa 59'] |
| NM_024006.5 (VKORC1):c.172A>G (p.Arg58Gly) | 104894541 | VKORC1 | [ ] | [ ] | ['Warfarin response'] |
| NM_001128085.1 (ASPA):c.692A>G (p.Tyr231Cys) | 104894550 | — | [ ] | [ ] | ['Spongy degeneration of central nervous system'] |
| NM_001128085.1 (ASPA):c.71A>G (p.Glu24Gly) | 104894551 | — | [ ] | [ ] | ['Spongy degeneration of central nervous system'] |
| NM_000019.3 (ACAT1):c.472A>G (p.Asn158Asp) | 148639841 | ACAT1 | [ ] | [ ] | ['Deficiency of acetyl-CoA acetyltransferase', 'not provided'] |
| NM_014254.2 (TMEM5):c.1016A>G (p.Tyr339Cys) | 150736997 | TMEM5 | [ ] | [ ] | ['Congenital muscular dystrophy-dystroglycanopathy with brain and eye anomalies, type A10'] |
| NM_005557.3 (KRT16):c.374A>G (p.Asn125Ser) | 60723330 | KRT16 | [ ] | ['GCGGTCAYTGA GGTTCTGCATGG'] | ['Pachyonychia congenita, type 1', 'Palmoplantar keratoderma, nonepidermolytic, focal', 'not provided'] |
| NM_005450.4 (NOG):c.665A>G (p.Tyr222Cys) | 104894602 | NOG | [ ] | [ ] | ['Tarsal carpal coalition syndrome', 'Cushing symphalangism'] |
| NM_030665.3 (RAI1):c.4685A>G (p.Gln1562Arg) | 104894634 | RAI1 | [ ] | ['CTGCTGCYGTCG TCGTCGCTTGG'] | ['Smith-Magenis syndrome'] |
| NM_000346.3 (SOX9):c.517A>G (p.Lys173Glu) | 104894647 | SOX9 | [ ] | [ ] | ['Acampomelic campomelic dysplasia'] |
| NM_024301.4 (FKRP):c.926A>G (p.Tyr309Cys) | 104894679 | FKRP | [ ] | [ ] | ['Congenital muscular dystrophy-dystroglycanopathy without mental retardation, type B5'] |
| NM_000495.4 (COL4A5):c.2394A>G (p.Lys798=) | 281874691 | COL4A5 | [ ] | [ ] | ['Alport syndrome, X-linked recessive'] |
| NM_001604.5 (PAX6):c.1075-2A>G | 794726661 | PAX6 | [ ] | [ ] | ['Congenital aniridia'] |
| NM_000363.4 (TNNI3):c.569A>G (p.Asp190Gly) | 104894728 | TNNI3 | [ ] | [ ] | ['Familial restrictive cardiomyopathy 1', 'Familial hypertrophic cardiomyopathy 7'] |
| NM_000363.4 (TNNI3):c.532A>G (p.Lys178Glu) | 104894730 | TNNI3 | [ ] | ['CCTYCTTCACCT GCTTGAGGTGG', 'CCTCCTYCTTCAC CTGCTTGAGG'] | ['Familial restrictive cardiomyopathy 1'] |
| NM_000054.4 (AVPR2):c.839A>G | 104894752 | AVPR2 | [ ] | [ ] | ['Nephrogenic diabetes insipidus, |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (p.Tyr280Cys) | | | | | X-linked'] |
| NM_000074.2 (CD40LG):c.386A>G (p.Glu129Gly) | 104894772 | CD40LG | [ ] | [ ] | ['Immunodeficiency with hyper IgM type 1'] |
| NM_000495.4 (COL4A5):c.4977-2A>G | 281874752 | COL4A5 | [ ] | [ ] | ['Alport syndrome, X-linked recessive'] |
| NM_001165963.1 (SCN1A):c.5264A>G (p.Asp1755Gly) | 794726722 | — | [ ] | [ ] | ['Severe myoclonic epilepsy in infancy'] |
| NM_000495.4 (COL4A5):c.547-2A>G | 281874756 | COL4A5 | [ ] | [ ] | ['Alport syndrome, X-linked recessive'] |
| NM_000495.4 (COL4A5):c.610-2A>G | 281874758 | COL4A5 | [ ] | [ ] | ['Alport syndrome, X-linked recessive'] |
| NM_032520.4 (GNPTG):c.610-2A>G | 193302855 | GNPTG | ['CCCYGAA GGTGGAGG ATGCAGGG'] | ['CCCYGAAGGTG GAGGATGCAGGG', 'GCCCYGAAGGTG GAGGATGCAGG'] | ['Mucolipidosis III Gamma'] |
| NM_002049.3 (GATA1):c.653A>G (p.Asp218Gly) | 104894816 | GATA1 | [ ] | ['GTCCTGYCCCTC CGCCACAGTGG'] | ['GATA-1-related thrombocytopenia with dyserythropoiesis'] |
| NM_000157.3 (GBA):c.680A>G (p.Asn227Ser) | 364897 | GBA | ['CCAYTGG TCTTGAGC CAAGTGGG', 'TCCAYTGG TCTTGAGC CAAGTGG'] | ['CCAYTGGTCTTG AGCCAAGTGGG', 'TCCAYTGGTCTT GAGCCAAGTGG'] | ['Gaucher disease', 'Subacute neuronopathic Gaucher disease', 'Gaucher disease, type 1'] |
| NM_001097642.2 (GJB1):c.194A>G (p.Tyr65Cys) | 104894819 | GJB1 | [ ] | [ ] | ['X-linked hereditary motor and sensory neuropathy'] |
| NM_000166.5 (GJB1):c.614A>G (p.Asn205Ser) | 104894822 | GJB1 | [ ] | [ ] | ['X-linked hereditary motor and sensory neuropathy'] |
| NM_001165963.1 (SCN1A):c.747T>G (p.Asp249Glu) | 773407463 | SCN1A | [ ] | [ ] | ['Severe myoclonic epilepsy in infancy'] |
| NM_000169.2 (GLA):c.886A>G (p.Met296Val) | 104894830 | — | [ ] | [ ] | ['Fabry disease', 'Fabry disease, cardiac variant'] |
| NM_000169.2 (GLA):c.101A>G (p.Asn34Ser) | 104894835 | — | [ ] | [ ] | ['Fabry disease'] |
| NM_001165963.1 (SCN1A):c.1662+3A>G | 794726773 | SCN1A | [ ] | ['GTGCCAYACCTG GTGTGGGGAGG'] | ['Severe myoclonic epilepsy in infancy'] |
| NM_000169.2 (GLA):c.1228A>G (p.Thr410Ala) | 104894852 | — | [ ] | [ ] | ['Fabry disease'] |
| NM_000202.6 (IDS):c.404A>G (p.Lys135Arg) | 104894861 | IDS | [ ] | ['AAAGACTYTTCC CACCGACATGG'] | ['Mucopolysaccharidosis, MPS-II'] |
| NM_001165963.1 (SCN1A):c.383+1A>G | 794726803 | SCN1A | [ ] | [ ] | ['Severe myoclonic epilepsy in infancy'] |
| NM_000266.3 (NDP):c.131A>G (p.Tyr44Cys) | 104894870 | NDP | [ ] | [ ] | ['Atrophia bulborum hereditaria'] |
| NM_000266.3 (NDP):c.125A>G (p.His42Arg) | 104894874 | NDP | [ ] | ['TGGYGCCTCATG CAGCGTCGAGG'] | [ ] |
| NM_001128227.2 (GNE):c.604A>G (p.Met202Val) | 121908634 | GNE | [ ] | [ ] | ['Inclusion body myopathy 2'] |
| NM_001165963.1 (SCN1A):c.3880-2A>G | 794726816 | — | [ ] | [ ] | ['Severe myoclonic epilepsy in infancy'] |
| NM_001165963.1 (SCN1A):c.1046A>G (p.Tyr349Cys) | 794726844 | SCN1A | ['ACATAYA TCCCTCTG GACATTGG'] | ['ACATAYATCCCT CTGGACATTGG'] | ['Severe myoclonic epilepsy in infancy'] |
| NM_001015877.1 (PHF6):c.700A>G (p.Lys234Glu) | 104894917 | PHF6 | [ ] | [ ] | ['Borjeson-Forssman-Lehmann syndrome'] |
| NM_001015877.1 | 104894918 | PHF6 | [ ] | [ ] | ['Borjeson— |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (PHF6):c.686A>G (p.His229Arg | | | | | Forssman-Lehmann syndrome'] |
| NM_001015877.1 (PHF6):c.769A>G (p.Arg257Gly) | 104894919 | PHF6 | ['CTCYTGA TGTTGTTG TGAGCTGG'] | ['CTCYTGATGTTG TTGTGAGCTGG'] | [Borjeson-Forssman-Lehmann syndrome'] |
| NM_000307.4 (POU3F4):c.1000A>G (p.Lys334Glu) | 104894922 | POU3F4 | [ ] | [ ] | ['Deafness, X-linked 2'] |
| NM_000330.3 (RS1):c.667T>C (p.Cys223Arg) | 104894929 | — | [ ] | [ ] | ['Juvenile retinoschisis'] |
| NM_003413.3 (ZIC3):c.1213A>G (p.Lys405Glu) | 104894962 | ZIC3 | ['TGTGTTY GCGCAGGG AGCTCGGG', 'ATGTGTTY GCGCAGGG AGCTCGG'] | ['TGTGTTYGCGCA GGGAGCTCGGG', 'ATGTGTTYGCGC AGGGAGCTCGG'] | ['Heterotaxy, visceral, X-linked'] |
| NM_002420.5 (TRPM1):c.296T>C (p.Leu99Pro) | 191205969 | TRPM1 | [ ] | ['AAGCYCTTAATA TCTGTGCATGG'] | ['Congenital stationary night blindness, type 1C'] |
| NM_004006.2 (DMD):c.1150-2A>G | 794727030 | DMD | [ ] | [ ] | ['Duchenne muscular dystrophy', 'Becker muscular dystrophy'] |
| NM_203290.2 (POLR1C):c.221A>G (p.Asn74Ser) | 371802902 | POLR1C | [ ] | [ ] | ['LEUKODYSTROPHY, HYPOMYELINATING, 11'] |
| NM_019109.4 (ALG1):c.1188-2A>G | 794727073 | ALG1 | [ ] | ['TAAACYGCAGA GAGAACCAAGGG', 'GTAAACYGCAGA GAGAACCAAGG'] | ['Congenital disorder of glycosylation type 1K'] |
| NM_004463.2 (FGD1):c.2016-2A>G | 794727099 | FGD1 | [ ] | [ ] | ['Aarskog syndrome'] |
| NM_024110.4 (CARD14):c.425A>G (p.Glu142Gly) | 281875213 | CARD14 | [ ] | [ ] | ['Psoriasis susceptibility 2', 'not provided'] |
| NM_001004334.3 (GPR179):c.659A>G (p.Tyr220Cys) | 281875236 | GPR179 | [ ] | ['CCCACAYATCCA TCTGCCTGCGG'] | ['Congenital stationary night blindness, type 1E', 'not provided'] |
| NM_018965.3 (TREM2):c.401A>G (p.Asp134Gly) | 28939079 | TREM2 | ['CCGGTGA YCCAGGGG GTCTATGG'] | ['TGAYCCAGGGG GTCTATGGGAGG', 'CGGTGAYCCAGG GGGTCTATGGG', 'CCGGTGAYCCAG GGGGTCTATGG'] | ['Polycystic lipomembranous osteodysplasia with sclerosing leukoencephalopathy'] |
| NM_015915.4 (ATL1):c.1222A>G (p.Met408Val) | 28939094 | ATL1 | [ ] | ['CACCCAYCTTCT TCACCCCTCGG'] | ['Spastic paraplegia 3'] |
| NM_002437.4 (MPV17):c.186+2T>C | 147952488 | MPV17 | ['TGGYAAG TTCTCCCC TCAACAGG'] | ['TGGYAAGTTCTC CCCTCAACAGG'] | ['Navajo neurohepatopathy', 'not provided'] |
| NM_005359.5 (SMAD4):c.1500A>G (p.Ile500Met) | 281875320 | SMAD4 | ['TGAGYAT GCATAAGC GACGAAG G'] | ['TGAGYATGCATA AGCGACGAAGG'] | ['Myhre syndrome', 'not provided'] |
| NM_005359.5 (SMAD4):c.1498A>G (p.Ile500Val) | 281875322 | SMAD4 | ['TGAGTAY GCATAAGC GACGAAG G'] | ['TGAGTAYGCATA AGCGACGAAGG'] | ['Hereditary cancer-predisposing syndrome', 'Myhre syndrome', 'not provided'] |
| NM_005359.5 (SMAD4):c.989A>G (p.Glu330Gly) | 281875324 | SMAD4 | [ ] | ['ATCCATTYCAAA GTAAGCAATGG'] | ['Juvenile polyposis syndrome', 'Hereditary cancer-predisposing syndrome', 'not provided'] |
| NM_000342.3 (SLC4A1):c.166A>G (p.Lys56Glu) | 5036 | SLC4A1 | [ ] | [ ] | [ ] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000518.4 (HBB):c.*113A>G | 33985472 | HBB | [ ] | [ ] | [ ] |
| NM_001127255.1 (NLRP7):c.2738A>G (p.Asn913Ser) | 104895503 | — | ['TCTGGYT GATACTCA AGTCCAGG'] | ['TCTGGYTGATAC TCAAGTCCAGG'] | ['Hydatidiform mole'] |
| NM_000037.3 (ANK1):c.-108T>C | 77173848 | ANK1 | [ ] | ['GGGCCYGGCCC GCACGTCACAGG'] | ['Spherocytosis, type 1, autosomal recessive'] |
| NM_201631.3 (TGM5):c.763T>C (p.Trp255Arg) | 115677373 | TGM5 | ['TGCGGAG YGGACGG GCAGCGTG G'] | ['TGCGGAGYGGA CGGGCAGCGTGG'] | ['Peeling skin syndrome, acral type'] |
| NM_020435.3 (GJC2):c.-167A>G | 587776888 | GJC2 | [ ] | [ ] | ['Leukodystrophy, hypomyelinating, 2'] |
| NM_130466.3 (UBE3B):c.1A>G (p.Met1Val) | 672601304 | UBE3B | [ ] | [ ] | ['Kaufman oculocerebrofacial syndrome'] |
| NM_022124.5 (CDH23):c.146-2A>G | 794727649 | — | [ ] | [ ] | ['Usher syndrome, type 1D'] |
| NM_014191.3 (SCN8A):c.667A>G (p.Arg223Gly) | 672601319 | SCN8A | [ ] | [ ] | ['Early infantile epileptic encephalopathy 13'] |
| NM_001164405.1 (BHLHA9):c.211A>G (p.Asn71Asp) | 672601337 | BHLHA9 | [ ] | [ ] | ['Syndactyly type 9'] |
| NM_021830.4 (C10orf2):c.1754A>G (p.Asn585Ser) | 672601360 | C10orf2 | [ ] | [ ] | ['Perrault syndrome 5'] |
| NM_002887.3 (RARS):c.5A>G (p.Asp2Gly) | 672601372 | RARS | [ ] | [ ] | ['Leukodystrophy, hypomyelinating, 9'] |
| NM_002887.3 (RARS):c.1A>G (p.Met1Val) | 672601375 | RARS | [ ] | [ ] | ['Leukodystrophy, hypomyelinating, 9'] |
| NM_001943.3 (DSG2):c.1880-2A>G | 397514038 | DSG2 | [ ] | [ ] | ['Arrhythmogenic right ventricular cardiomyopathy, type 10', 'Cardiomyopathy'] |
| NM_024422.4 (DSC2):c.631-2A>G | 397514042 | DSC2 | [ ] | [ ] | ['Arrhythmogenic right ventricular cardiomyopathy, type 11', 'Cardiomyopathy'] |
| NM_001159772.1 (CANT1):c.671T>C (p.Leu224Pro) | 150181226 | CANT1 | [ ] | ['CGTCYGTACGTG GGCGGCCTGGG', 'GCGTCYGTACGT GGGCGGCCTGG'] | ['Desbuquois syndrome'] |
| NM_031418.2 (ANO3):c.2053A>G (p.Ser685Gly) | 587776923 | ANO3 | [ ] | [ ] | ['Dystonia 24'] |
| NM_014191.3 (SCN8A):c.5302A>G (p.Asn1768Asp) | 202151337 | SCN8A | [ ] | [ ] | ['Early infantile epileptic encephalopathy 13'] |
| NM_000367.3 (TPMT):c.719A>G (p.Tyr240Cys) | 1142345 | TPMT | [ ] | [ ] | ['Thiopurine methyltransferase deficiency'] |
| NM_003907.2 (EIF2B5):c.271A>G (p.Thr91Ala) | 28939717 | EIF2B5 | ['AAATGYT TCCTGTAC ACCTGTGG'] | ['AAATGYTTCCTG TACACCTGTGG'] | ['Leukoencephalopathy with vanishing white matter'] |
| NM_004006.2 (DMD):c.10554-2A>G | 794727890 | DMD | [ ] | [ ] | ['Duchenne muscular dystrophy', 'Becker muscular dystrophy', 'Dilated cardiomyopathy 3B'] |
| NM_000084.4 (CLCN5):c.815A>G (p.Tyr272Cys) | 273585644 | CLCN5 | [ ] | [ ] | ['Dent disease 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000084.4 (CLCN5):c.1637A>G (p.Lys546Arg) | 273585649 | CLCN5 | [ ] | [ ] | ['Dent disease 1'] |
| NM_000041.3 (APOE):c.237-2A>G | 397514253 | APOE | [ ] | ['CGCCCYGCGGCC GAGAGGGCGGG', 'GCGCCCYGCGGC CGAGAGGGCGG'] | ['Familial type 3 hyperlipoproteinemia'] |
| NM_000155.3 (GALT):c.940A>G (p.Asn314Asp) | 2070074 | GALT | [ ] | [ ] | ['Deficiency of UDPglucose-hexose-1-phosphate uridylyltransferase', 'not provided'] |
| NM_005045.3 (RELN):c.2288A>G (p.Asp763Gly) | 794727998 | RELN | [ ] | [ ] | ['EPILEPSY, FAMILIAL TEMPORAL LOBE, 7'] |
| NM_001914.3 (CYB5A):c.130-2A>G | 794728010 | CYB5A | [ ] | [ ] | ['Methemoglobinemia type 4'] |
| NM_001613.2 (ACTA2):c.1A>G (p.Met1Val) | 794728019 | ACTA2 | [ ] | [ ] | ['Thoracic aortic aneurysms and aortic dissections'] |
| NM_000109.3 (DMD):c.1700T>C (p.Leu567Pro) | 370644567 | DMD | [ ] | [ ] | ['Becker muscular dystrophy', 'Exertional myalgia, muscle stiffness and myoglobinuria', 'not provided'] |
| NM_000060.3 (BTD):c.194A>G (p.His65Arg) | 397514341 | BTD | [ ] | [ ] | ['Biotinidase deficiency'] |
| NM_000060.3 (BTD):c.278A>G (p.Tyr93Cys) | 397514348 | BTD | [ ] | ['GTTCAYAGATGT CAAGGTTCTGG'] | ['Biotinidase deficiency'] |
| NM_000060.3 (BTD):c.356A>G (p.Asn119Ser) | 397514353 | BTD | [ ] | [ ] | ['Biotinidase deficiency'] |
| NM_000060.3 (BTD):c.364A>G (p.Arg122Gly) | 397514354 | BTD | [ ] | [ ] | ['Biotinidase deficiency'] |
| NM_000060.3 (BTD):c.515A>G (p.Asn172Ser) | 397514366 | BTD | [ ] | [ ] | ['Biotinidase deficiency'] |
| NM_000060.3 (BTD):c.583A>G (p.Asn195Asp) | 397514370 | BTD | [ ] | [ ] | ['Biotinidase deficiency'] |
| NM_000060.3 (BTD):c.584A>G (p.Asn195Ser) | 397514371 | BTD | [ ] | [ ] | ['Biotinidase deficiency', 'not provided'] |
| NM_000060.3 (BTD):c.641A>G (p.Asn214Ser) | 397514377 | BTD | ['AGAGGYT GTGTTTAC GGTAGCGG'] | ['AGAGGYTGTGTT TACGGTAGCGG'] | ['Biotinidase deficiency'] |
| NM_000061.2 (BTK):c.1288A>G (p.Lys430Glu) | 128620184 | BTK | ['TCTYGAT GGCCACGT CGTACTGG'] | ['TCTYGATGGCCA CGTCGTACTGG'] | ['X-linked agammaglobulinemia'] |
| NM_001002294.2 (FMO3):c.923A>G (p.Glu308Gly) | 2266780 | FMO3 | [ ] | [ ] | ['Trimethylaminuria'] |
| m.15579A>G | 207460002 | MT-CYB | [ ] | [ ] | ['Multisystem disorder'] |
| NM_000060.3 (BTD):c.1313A>G (p.Tyr438Cys) | 397514415 | BTD | [ ] | ['GGCAYACAGCT CTTTGGATAAGG'] | ['Biotinidase deficiency'] |
| NM_000060.3 (BTD):c.1619A>G (p.Tyr540Cys) | 397514431 | BTD | [ ] | [ ] | ['Biotinidase deficiency'] |
| NM_000023.2 (SGCA):c.410A>G (p.Glu137Gly) | 397514451 | SGCA | [ ] | [ ] | ['Limb-girdle muscular dystrophy, type 2D'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_004813.2 (PEX16):c.992A>G (p.Tyr331Cys) | 397514472 | PEX16 | ['AAGYAGA TTTTCTGC CAGGTGGG', 'GAAGYAG ATTTTCTG CCAGGTGG', 'GTAGAAG YAGATTTT CTGCCAGG'] | ['AAGYAGATTTTC TGCCAGGTGGG', 'GAAGYAGATTTT CTGCCAGGTGG', 'GTAGAAGYAGAT TTTCTGCCAGG'] | ['Peroxisome biogenesis disorder 8B'] |
| NM_000933.3 (PLCB4):c.1868A>G (p.Tyr623Cys) | 397514480 | PLCB4 | [ ] | [ ] | ['Auriculocondylar syndrome 1', 'Auriculocondylar syndrome 2'] |
| NM_005340.6 (HINT1):c.152A>G (p.His51Arg) | 397514491 | HINT1 | ['AAAAYGT GTTGGTGC TTGAGGGG', 'GAAAAYG TGTTGGTG CTTGAGGG', 'AGAAAAY GTGTTGGT GCTTGAGG'] | ['AAAAYGTGTTG GTGCTTGAGGGG', 'GAAAAYGTGTTG GTGCTTGAGGG', 'AGAAAAYGTGTT GGTGCTTGAGG'] | ['Gamstorp-Wohlfart syndrome'] |
| NM_007171.3 (POMT1):c.430A>G (p.Asn144Asp) | 397514501 | POMT1 | [ ] | ['GAGCATYCTCTG TTTCAAAGAGG'] | ['Limb-girdle muscular dystrophy-dystroglycanopathy, type C1'] |
| NM_003863.3 (DPM2):c.68A>G (p.Tyr23Cys) | 397514503 | DPM2 | ['TGTAGYA GGTGAAGA TGATCAGG'] | ['TGTAGYAGGTG AAGATGATCAGG'] | ['Congenital disorder of glycosylation type 1u'] |
| NM_174917.4 (ACSF3):c.1A>G (p.Met1Val) | 370382601 | ACSF3 | [ ] | ['GGCAGCAYTGC ACTGACAGGCGG'] | ['not provided'] |
| NM_183075.2 (CYP2U1):c.1139A>G (p.Glu380Gly) | 397514514 | CYP2U1 | [ ] | [ ] | ['Spastic paraplegia 56, autosomal recessive'] |
| NM_000344.3 (SMN1):c.389A>G (p.Tyr130Cys) | 397514517 | SMN1 | [ ] | [ ] | ['Kugelberg-Welander disease'] |
| NM_000138.4 (FBN1):c.4337-2A>G | 794728216 | FBN1 | [ ] | [ ] | ['Thoracic aortic aneurysms and aortic dissections'] |
| NM_012082.3 (ZFPM2):c.2209A>G (p.Lys737Glu) | 397514521 | — | [ ] | [ ] | ['Double outlet right ventricle'] |
| NM_001168272.1 (ITPR1):c.1759A>G (p.Asn587Asp) | 397514536 | ITPR1 | [ ] | [ ] | ['Spinocerebellar ataxia 29'] |
| NM_178012.4 (TUBB2B):c.767A>G (p.Asn256Ser) | 397514568 | TUBB2B | [ ] | [ ] | ['Polymicrogyria, asymmetric'] |
| NM_000531.5 (OTC):c.155A>G (p.Glu52Gly) | 72554317 | OTC | [ ] | [ ] | ['not provided'] |
| NM_001866.2 (COX7B):c.41-2A>G | 397514584 | COX7B | [ ] | [ ] | ['Aplasia cutis congenita, reticulolinear, with microcephaly, facial dysmorphism, and other congenital anomalies'] |
| NM_001099922.2 (ALG13):c.339A>G (p.Ala113=) | 397514587 | ALG13 | [ ] | [ ] | ['Congenital disorder of glycosylation type 1s'] |
| NM_000531.5 (OTC):c.238A>G (p.Lys80Glu) | 72554332 | OTC | [ ] | ['AAGGACTYCCCT TGCAATAAAGG'] | ['Ornithine carbamoyltransferase deficiency', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001083614.1 (EAR52):c.502A>G (p.Arg168Gly) | 397514591 | EARS2 | [ ] | [ ] | ['Combined oxidative phosphorylation deficiency 12'] |
| NM_001083614.1 (EARS2):c.193A>G (p.Lys65Glu) | 397514595 | EARS2 | [ ] | [ ] | ['Combined oxidative phosphorylation deficiency 12'] |
| NM_198578.3 (LRRK2):c.3364A>G (p.Ile1122Val) | 34805604 | LRRK2 | [ ] | [ ] | ['Parkinson disease 8, autosomal dominant'] |
| NM_033109.4 (PNPT1):c.1160A>G (p.Gln387Arg) | 397514598 | PNPT1 | [ ] | [ ] | ['Combined oxidative phosphorylation deficiency 13'] |
| NM_033109.4 (PNPT1):c.1424A>G (p.Glu475Gly) | 397514599 | PNPT1 | [ ] | ['GACTYCAGATGT AACTCTTATGG'] | ['Deafness, autosomal recessive 70'] |
| NM_000531.5 (OTC):c.277A>G (p.Thr93Ala) | 72554344 | OTC | [ ] | [ ] | ['not provided'] |
| NM_000390.2 (CHM):c.1520A>G (p.His507Arg) | 397514603 | CHM | [ ] | [ ] | ['Choroideremia'] |
| NM_181690.2 (AKT3):c.686A>G (p.Asn229Ser) | 397514605 | AKT3 | [ ] | [ ] | ['Megalencephaly-polymicrogyria-polydactyly-hydrocephalus syndrome 2'] |
| NM_006567.3 (FARS2):c.431A>G (p.Tyr144Cys) | 397514610 | FARS2 | [ ] | [ ] | ['Mitochondrial encephalomyopathy', 'Combined oxidative phosphorylation deficiency 14', 'Global developmental delay'] |
| NM_000531.5 (OTC):c.377A>G (p.Asp126Gly) | 72554358 | OTC | [ ] | [ ] | ['not provided'] |
| NM_005609.2 (PYGM):c.152A>G (p.Asp51Gly) | 397514631 | PYGM | [ ] | [ ] | ['Glycogen storage disease, type V'] |
| NM_000130.4 (F5):c.1601G>A (p.Arg534Gln) | 6025 | F5 | [ ] | [ ] | ['Recurrent abortion', 'Thrombophilia due to factor V Leiden'] |
| NM_000108.4 (DLD):c.1444A>G (p.Arg482Gly) | 397514650 | DLD | [ ] | ['GACTCYAGCTAT ATCTTCACAGG'] | ['Maple syrup urine disease, type 3'] |
| NM_138554.4 (TLR4):c.896A>G (p.Asp299Gly) | 4986790 | TLR4 | [ ] | [ ] | ['Endotoxin hyporesponsiveness'] |
| NM_003156.3 (STIM1):c.251A>G (p.Asp84Gly) | 397514675 | STIM1 | [ ] | ['TTCCACAYCCAC ATCACCATTGG'] | ['Myopathy with tubular aggregates'] |
| NM_003156.3 (STIM1):c.326A>G (p.His109Arg) | 397514677 | STIM1 | [ ] | [ ] | ['Myopathy with tubular aggregates'] |
| NM_000238.3 (KCNH2):c.1900A>G (p.Thr634Ala) | 794728377 | KCNH2 | [ ] | [ ] | ['Cardiac arrhythmia'] |
| NM_000238.3 (KCNH2):c.1913A>G (p.Lys638Arg) | 794728378 | KCNH2 | [ ] | ['ATCYTCTCTGAG TTGGTGTTGGG', 'GATCYTCTCTGA GTTGGTGTTGG'] | ['Cardiac arrhythmia'] |
| NM_001457.3 (FLNB):c.604A>G (p.Met202Val) | 121908895 | FLNB | [ ] | [ ] | ['Atelosteogenesis type 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001893.4 (CSNK1D):c.137A>G (p.His46Arg) | 397514693 | CSNK1D | [ ] | [ ] | ['Advanced sleep phase syndrome, familial, 2'] |
| NM_002163.2 (IRF8):c.322A>G (p.Lys108Glu) | 397514710 | IRF8 | [ ] | [ ] | ['Monocyte and dendritic cell deficiency, autosomal recessive'] |
| NM_002163.2 (IRF8):c.238A>G (p.Thr80Ala) | 397514711 | IRF8 | [ ] | ['AACCTCGYCTTC CAAGTGGCTGG'] | ['Autosomal dominant CD11C+/CD1C+ dendritic cell deficiency'] |
| NM_001127217.2 (SMAD9):c.127A>G (p.Lys43Glu) | 397514715 | SMAD9 | [ ] | [ ] | ['Primary pulmonary hypertension 2'] |
| NM_001035.2 (RYR2):c.12290A>G (p.Asn4097Ser) | 794728784 | RYR2 | [ ] | [ ] | ['not provided'] |
| NM_000388.3 (CASR):c.85A>G (p.Lys29Glu) | 397514729 | CASR | [ ] | ['CCCCCTYCTTTT GGGCTCGCTGG'] | ['Hypocalcemia, autosomal dominant 1, with bartter syndrome'] |
| NM_003793.3 (CTSF):c.962A>G (p.Gln321Arg) | 397514731 | CTSF | [ ] | [ ] | ['Ceroid lipofuscinosis, neuronal, 13'] |
| NM_173076.2 (ABCA12):c.4139A>G (p.Asn1380Ser) | 28940269 | ABCA12 | [ ] | [ ] | ['Autosomal recessive congenital ichthyosis 4A'] |
| NM_017890.4 (VPS13B):c.8978A>G (p.Asn2993Ser) | 28940272 | VPS13B | ['TCAYTGA TAAGCAGG GCCCAGGG', 'TTCAYTGA TAAGCAGG GCCCAGG'] | ['TCAYTGATAAGC AGGGCCCAGGG', 'TTCAYTGATAAG CAGGGCCCAGG'] | ['Cohen syndrome', 'not specified'] |
| NM_022114.3 (PRDM16):c.2447A>G (p.Asn816Ser) | 397514743 | PRDM16 | [ ] | ['GCCGCCGYTTTG GCTGGCACGGG'] | ['Left ventricular noncompaction 8'] |
| NM_005689.2 (ABCB6):c.508A>G (p.Ser170Gly) | 397514757 | ABCB6 | [ ] | ['TGGGCYGTTCCA AGACACCAGGG', 'GTGGGCYGTTCC AAGACACCAGG'] | ['Dyschromatosis universalis hereditaria 3'] |
| NM_015335.4 (MED13L):c.752A>G (p.Glu251Gly) | 28940309 | MED13L | [ ] | [ ] | ['Transposition of great arteries'] |
| NM_152443.2 (RDH12):c.677A>G (p.Tyr226Cys) | 28940313 | RDH12 | [ ] | ['CACTGCGYAGGT GGTGACCCCGG'] | ['Leber congenital amaurosis 13'] |
| NM_000517.4 (HBA2):c.96-2A>G | 41457746 | HBA2 | [ ] | [ ] | [ ] |
| NM_000218.2 (KCNQ1):c.1787A>G (p.Glu596Gly) | 794728538 | KCNQ1 | [ ] | ['GTCTYCTACTCG GTTCAGGCGGG', 'TGTCTYCTACTCG GTTCAGGCGG'] | ['Cardiac arrhythmia'] |
| NM_000218.2 (KCNQ1):c.605A>G (p.Asp202Gly) | 794728569 | KCNQ1 | [ ] | ['AGGYCTGTGGA GTGCAGGAGAGG'] | ['Cardiac arrhythmia'] |
| NM_000218.2 (KCNQ1):c.1515-2A>G | 794728573 | KCNQ1 | [ ] | ['GCCYGCAGTGG AGAGAGGAGAGG'] | ['Cardiac arrhythmia'] |
| NM_000498.3 (CYP11B2):c.1492A>G (p.Thr498Ala) | 72554626 | — | [ ] | [ ] | ['Corticosterone methyloxidase type 2 deficiency'] |
| NM_000169.2 (GLA):c.644A>G (p.Asn215Ser) | 28935197 | — | [ ] | [ ] | ['Fabry disease', 'not provided'] |
| NM_000218.2 (KCNQ1):c.1085A>G (p.Lys362Arg) | 12720458 | KCNQ1 | [ ] | [ ] | ['Congenital long QT syndrome', 'Cardiac arrhythmia', 'Long QT syndrome, LQT1 subtype'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001035.2 (RYR2):c.12533A>G (p.Asn4178Ser) | 794728787 | RYR2 | [ ] | [ ] | ['not provided'] |
| NM_003494.3 (DYSF):c.3349-2A>G | 370874727 | DYSF | [ ] | ['CCGCCCYGGAG ACACGAAGCTGG'] | ['Limb-girdle muscular dystrophy, type 2B'] |
| NM_001035.2 (RYR2):c.568A>G (p.Arg190Gly) | 794728814 | RYR2 | [ ] | [ ] | ['not provided'] |
| NM_198056.2 (SCN5A):c.2788-2A>G | 794728859 | SCN5A | [ ] | ['ACCYGTCGAGAT AATGGGTCAGG'] | ['not provided'] |
| NM_198056.2 (SCN5A):c.4453A>G (p.Ile1485Val) | 794728886 | SCN5A | [ ] | [ ] | ['not provided'] |
| NM_198056.2 (SCN5A):c.4462A>G (p.Thr1488Ala) | 794728887 | SCN5A | [ ] | ['CCTCTGYCATGA AGATGTCCTGG'] | ['not provided'] |
| NM_001927.3 (DES):c.1324A>G (p.Thr442Ala) | 794728995 | DES | [ ] | [ ] | ['not provided'] |
| NM_001613.2 (ACTA2):c.145A>G (p.Met49Val) | 397515325 | ACTA2 | [ ] | [ ] | ['Aortic aneurysm, familial thoracic 6'] |
| NM_000782.4 (CYP24A1):c.1226T>C (p.Leu409Ser) | 6068812 | CYP24A1 | [ ] | [ ] | ['Idiopathic hypercalcemia of infancy'] |
| NM_000372.4 (TYR):c.125A>G (p.Asp42Gly) | 28940878 | TYR | [ ] | ['CTCCTGYCCCCG CTCCACGGTGG'] | ['Tyrosinase-negative oculocutaneous albinism', 'not provided'] |
| NM_000372.4 (TYR):c.1A>G (p.Met1Val) | 28940881 | TYR | [ ] | [ ] | ['Tyrosinase-negative oculocutaneous albinism', 'Oculocutaneous albinism type 1B', 'not provided'] |
| NM_000403.3 (GALE):c.770A>G (p.Lys257Arg) | 28940884 | GALE | [ ] | [ ] | ['UDPglucose-4-epimerase deficiency'] |
| NM_000529.2 (MC2R):c.761A>G (p.Tyr254Cys) | 28940892 | MC2R | ['ACATGYA GCAGGCGC AGTAGGG', 'GACATGY AGCAGGCG CAGTAGGG'] | ['ACATGYAGCAG GCGCAGTAGGGG', 'GACATGYAGCAG GCGCAGTAGGG', 'AGACATGYAGCA GGCGCAGTAGG'] | ['ACTH resistance'] |
| NM_000061.2 (BTK):c.919A>G (p.Arg307Gly) | 128621195 | BTK | [ ] | [ ] | ['X-linked agammaglobulinemia'] |
| NM_000061.2 (BTK):c.1766A>G (p.Glu589Gly) | 128621206 | BTK | [ ] | [ ] | ['X-linked agammaglobulinemia'] |
| NM_018486.2 (HDAC8):c.539A>G (p.His180Arg) | 397515416 | HDAC8 | [ ] | [ ] | ['Cornelia de Lange syndrome 5'] |
| NM_018486.2 (HDAC8):c.1001A>G (p.His334Arg) | 397515418 | HDAC8 | ['CTCAYGA TCTGGGAT CTCAGAGG'] | ['CTCAYGATCTGG GATCTCAGAGG'] | ['Cornelia de Lange syndrome 5'] |
| NM_172107.2 (KCNQ2):c.1636A>G (p.Met546Val) | 397515420 | KCNQ2 | [ ] | ['GCAYGACACTG CAGGGGGGTGGG', 'CGCAYGACACTG CAGGGGGGTGG', 'AACCGCAYGACA CTGCAGGGGGG'] | ['Early infantile epileptic encephalopathy 7'] |
| NM_001410.2 (MEGF8):c.7099A>G (p.Ser2367Gly) | 397515428 | MEGF8 | [ ] | ['GACYCCCGTGA AATGATTCCCGG'] | ['Carpenter syndrome 2'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_004247.3 (EFTUD2):c.623A>G (p.His208Arg) | 397515431 | EFTUD2 | [ ] | [ ] | ['Growth and mental retardation, mandibulofacial dysostosis, microcephaly, and cleft palate'] |
| NM_004572.3 (PKP2):c.1171-2A>G | 794729133 | PKP2 | [ ] | [ ] | ['not provided'] |
| NM_018972.2 (GDAP1):c.368A>G (p.His123Arg | 397515442 | GDAP1 | [ ] | [ ] | ['Charcot-Marie-Tooth disease type 2K'] |
| NM_014795.3 (ZEB2):c.3134A>G (p.His1045Arg) | 397515449 | ZEB2 | [ ] | [ ] | ['Mowat-Wilson syndrome'] |
| NM_002336.2 (LRP6):c.1298A>G (p.Asn433Ser) | 397515473 | LRP6 | [ ] | [ ] | ['Coronary artery disease, autosomal dominant 2'] |
| NM_001015879.1 (AURKC):c.379-2A>G | 397515484 | AURKC | [ ] | [ ] | ['Infertility associated with multi-tailed spermatozoa and excessive DNA'] |
| NM_000495.4 (COL4A5):c.3107-4A>G | 397515497 | COL4A5 | [ ] | [ ] | ['Alport syndrome, X-linked recessive'] |
| NM_201631.3 (TGM5):c.122T>C (p.Leu41Pro) | 143601447 | TGM5 | [ ] | ['TCAACCYCACCC TGTACTTCAGG'] | ['Peeling skin syndrome, acral type'] |
| NM_013254.3 (TBK1):c.1201A>G (p.Lys401Glu) | 756751089 | TBK1 | [ ] | [ ] | ['FRONTOTEMPORAL DEMENTIA AND/OR AMYOTROPHIC LATERAL SCLEROSIS 4'] |
| NM_000207.2 (INS):c.*59A>G | 397515519 | — | [ ] | ['GGGCYTTATTCC ATCTCTCTCGG'] | ['Permanent neonatal diabetes mellitus'] |
| NM_000370.3 (TTPA):c.191A>G (p.Asp64Gly) | 397515523 | TTPA | [ ] | ['CAGGYCCAGAT CGAAATCCCGGG', 'CCAGGYCCAGAT CGAAATCCCGG'] | ['Ataxia with vitamin E deficiency'] |
| NM_001006657.1 (WDR35):c.2912A>G (p.Tyr971Cys) | 397515535 | WDR35 | [ ] | [ ] | ['Cranioectodermal dysplasia 2'] |
| NM_000424.3 (KRT5):c.1424A>G (p.Glu475Gly) | 61348633 | KRT5 | [ ] | [ ] | ['Epidermolysis bullosa herpetiformis, Dowling-Meara', 'not provided'] |
| NM_004595.4 (SMS):c.443A>G (p.Gln148Arg) | 397515551 | SMS | [ ] | [ ] | ['Snyder Robinson syndrome'] |
| NM_001256850.1 (TTN):c.45629-2A>G | 794729266 | — | [ ] | [ ] | ['not provided'] |
| NM_000404.2 (GLB1):c.947A>G (p.Tyr316Cys) | 72555361 | GLB1 | [ ] | [ ] | ['Infantile GM1 gangliosidosis'] |
| NM_000404.2 (GLB1):c.1498A>G (p.Thr500Ala) | 72555368 | GLB1 | [ ] | [ ] | ['Mucopolysaccharidosis, MPS-IV-B'] |
| NM_000404.2 (GLB1):c.1772A>G (p.Tyr591Cys) | 72555371 | GLB1 | [ ] | [ ] | ['GM1-GANGLIOSIDOSIS, TYPE I, WITH CARDIAC INVOLVEMENT'] |
| NM_000487.5 (ARSA):c.1055A>G (p.Asn352Ser) | 2071421 | ARSA | [ ] | [ ] | ['Metachromatic leukodystrophy', 'not provided'] |
| NM_001037811.2 (HSD17B10):c.713A>G (p.Asn238Ser) | 122461163 | HSD17B10 | [ ] | [ ] | [2-methyl-3-hydroxybutyric aciduria'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000138.4 (FBN1):c.1148-2A>G | 397515756 | FBN1 | [ ] | [ ] | ['Marfan syndrome'] |
| NM_001875.4 (CPS1):c.1010A>G (p.His337Arg) | 28940283 | CPS1 | [ ] | [ ] | ['Congenital hyperammonemia, type I'] |
| NM_000169.2 (GLA):c.1153A>G (p.Thr385Ala) | 397515869 | — | ['AGCTGTG YGATGAAG CAGGCAGG'] | ['AGCTGTGYGATG AAGCAGGCAGG'] | ['not specified', 'not provided'] |
| NM_000256.3 (MYBPC3):c.1224-2A>G | 397515891 | MYBPC3 | [ ] | ['TACTTGCYGTAG AACAGAAGGGG'] | ['Familial hypertrophic cardiomyopathy 4', 'Cardiomyopathy'] |
| NM_000048.3 (ASL):c.857A>G (p.Gln286Arg) | 28941472 | ASL | [ ] | [ ] | ['Argininosuccinate lyase deficiency', 'not provided'] |
| NM_000256.3 (MYBPC3):c.1928-2A>G | 397515937 | MYBPC3 | [ ] | [ ] | ['Primary familial hypertrophic cardiomyopathy', 'Familial hypertrophic cardiomyopathy 4', 'Cardiomyopathy'] |
| NM_002693.2 (POLG):c.1283T>C (p.Leu428Pro) | 774610098 | POLG | [ ] | [ ] | ['not provided'] |
| NM_004628.4 (XPC):c.413-24A>G | 794729657 | XPC | [ ] | [ ] | ['Xeroderma pigmentosum, group C'] |
| NM_030973.3 (MED25):c.116A>G (p.Tyr39Cys) | 794729668 | MED25 | [ ] | [ ] | ['BASEL-VANAGAITE-SMIRIN-YOSEF SYNDROME'] |
| NM_001955.4 (EDN1):c.271A>G (p.Lys91Glu) | 587777231 | EDN1 | [ ] | [ ] | ['Auriculocondylar syndrome 3'] |
| NM_003002.3 (SDHD):c.149A>G (p.His50Arg) | 11214077 | SDHD | [ ] | [ ] | ['Pheochromocytoma', 'Merkel cell carcinoma', 'Hereditary cancer-predisposing syndrome', 'Carcinoid tumor of intestine', 'Cowden syndrome 3', 'not specified', 'not provided'] |
| NM_001003722.1 (GLE1):c.433-10A>G | 386833693 | GLE1 | [ ] | [ ] | ['Lethal arthrogryposis with anterior horn cell disease'] |
| NM_000371.3 (TTR):c.185A>G (p.Glu62Gly) | 11541796 | TTR | [ ] | [ ] | ['Amyloidogenic transthyretin amyloidosis'] |
| NM_000256.3 (MYBPC3):c.927-2A>G | 397516082 | MYBPC3 | [ ] | ['GTCCCYGTGTCC CGCAGTCTAGG'] | ['Familial hypertrophic cardiomyopathy 4', 'Cardiomyopathy'] |
| NM_001148.4 (ANK2):c.4373A>G (p.Glu1458Gly) | 72544141 | ANK2 | [ ] | [ ] | ['Long QT syndrome', 'Congenital long QT syndrome', 'Long QT syndrome 4', 'Cardiac arrhythmia, ankyrin B-related', 'Cardiac arrhythmia'] |
| NM_000257.3 (MYH7):c.2206A>G (p.Ile736Val) | 397516138 | MYH7 | [ ] | ['TATCAAYGAACT GTCCCTCAGGG', 'CTATCAAYGAAC TGTCCCTCAGGG'] | ['Familial hypertrophic cardiomyopathy 1', 'Cardiomyopathy', 'not specified'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000356.3 (TCOF1):c.149A>G (p.Tyr50Cys) | 28941769 | TCOF1 | ['GTGTGTA YAGATGTC CAGAAGGG'] | ['GTGTGTAYAGAT GTCCAGAAGGG'] | ['Treacher collins syndrome 1'] |
| NM_002150.2 (HPD):c.97G>A (p.Ala33Thr) | 1154510 | HPD | [ ] | ['ATGACGYGGCCT GAATCACAGGG', 'AATGACGYGGCC TGAATCACAGG'] | [4-Alpha— hydroxyphenylpyruvate hydroxylase deficiency'] |
| NM_000375.2 (UROS):c.184A>G (p.Thr62Ala) | 28941775 | UROS | [ ] | [ ] | ['Congenital erythropoietic porphyria'] |
| NM_001008216.1 (GALE):c.308A>G (p.Asp103Gly) | 28940883 | GALE | [ ] | [ ] | ['UDPglucose-4-epimerase deficiency'] |
| NM_000260.3 (MYO7A):c.6439-2A>G | 397516330 | MYO7A | [ ] | ['ATATCCYGGGG GAGCAGAAAGGG', 'GATATCCYGGGG GAGCAGAAAGG'] | ['Usher syndrome, type 1'] |
| NM_033071.3 (SYNE1):c.15705-12A>G | 606231134 | SYNE1 | [ ] | [ ] | ['Spinocerebellar ataxia, autosomal recessive 8'] |
| NM_000187.3 (HGD):c.1112A>G (p.His371Arg) | 120074172 | HGD | [ ] | [ ] | ['Alkaptonuria'] |
| NM_000053.3 (ATP7B1:c.3443T>C (p.Ile1148Thr) | 60431989 | ATP7B | ['TGCTGAY TGGAAACC GTGAGTGG'] | ['TGCTGAYTGGAA ACCGTGAGTGG'] | ['Wilson disease'] |
| NM_000441.1 (SLC26A4):c.-3-2A>G | 397516411 | — | [ ] | [ ] | ['Pendred syndrome', 'Enlarged vestibular aqueduct syndrome'] |
| NM_003041.3 (SLC5A2):c.1961A>G (p.Asn654Ser) | 61742739 | — | [ ] | [ ] | ['Familial renal glucosuria'] |
| NM_000551.3 (VHL):c.467A>G (p.Tyr156Cys) | 397516441 | VHL | [ ] | [ ] | ['Von Hippel-Lindau syndrome'] |
| NM_000531.5 (OTC):c.481A>G (p.Asn161Asp) | 72556270 | OTC | [ ] | [ ] | ['not provided'] |
| NM_000531.5 (OTC):c.482A>G (p.Asn161Ser) | 72556271 | OTC | [ ] | ['CAGCCCAYTGAT AATTGGGATGG'] | ['not provided'] |
| NM_000531.5 (OTC):c.541-2A>G | 72556289 | OTC | ['TCCYAAA AGGCACGG GATGAAGG'] | ['TCCYAAAAGGC ACGGGATGAAGG'] | ['not provided'] |
| NM_000531.5 (OTC):c.542A>G (p.Glu181Gly) | 72556290 | OTC | ['ATAGTGT YCCTAAAA GGCACGGG'] | ['ATAGTGTYCCTA AAAGGCACGGG'] | ['not provided'] |
| NM_000527.4 (LDLR):c.2483A>G (p.Tyr828Cys) | 28942085 | LDLR | [ ] | [ ] | ['Familial hypercholesterolemia', 'not provided'] |
| NM_000271.4 (NPC1):c.3467A>G (p.Asn1156Ser) | 28942105 | NPC1 | [ ] | [ ] | ['Niemann-Pick disease type C1'] |
| NM_000271.4 (NPC1):c.3263A>G (p.Tyr1088Cys) | 28942106 | NPC1 | [ ] | [ ] | ['NIEMANN-PICK DISEASE, TYPE C1, JUVENILE FORM'] |
| NM_020247.4 (ADCK3):c.1541A>G (p.Tyr514Cys) | 119468008 | ADCK3 | [ ] | [ ] | ['Coenzyme Q10 deficiency, primary, 4'] |
| NM_001063.3 (TF):c.956A>G (p.His319Arg) | 41295774 | TF | [ ] | [ ] | [ ] |
| NM_172201.1 (KCNE2):c.281A>G (p.Glu94Gly) | 74424227 | KCNE2 | [ ] | [ ] | ['Congenital long QT syndrome'] |
| NM_002294.2 (LAMP2):c.65-2A>G | 397516743 | LAMP2 | [ ] | [ ] | ['Danon disease'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_002880.3 (RAF1):c.524A>G (p.His175Arg) | 397516822 | RAF1 | [ ] | [ ] | ['Noonan syndrome 5'] |
| NM_033360.3 (KRAS):c.13A>G (p.Lys5Glu) | 193929331 | KRAS | [ ] | [ ] | ['Noonan syndrome 3', 'Rasopathy'] |
| NM_000525.3 (KCNJ11):c.155A>G (p.Gln52Arg) | 193929337 | KCNJ11 | [ ] | [ ] | ['Permanent neonatal diabetes mellitus'] |
| NM_000525.3 (KCNJ11):c.544A>G (p.Ile182Val) | 193929348 | KCNJ11 | ['AGAYGAG GGTCTCAG CCCTGCGG'] | ['AGAYGAGGGTC TCAGCCCTGCGG'] | ['Permanent neonatal diabetes mellitus'] |
| NM_000525.3 (KCNJ11):c.989A>G (p.Tyr330Cys) | 193929356 | KCNJ11 | [ ] | [ ] | ['Permanent neonatal diabetes mellitus', 'Neonatal insulin-dependent diabetes mellitus'] |
| NM_001288953.1 (TTC7A):c.1715A>G (p.Lys572Arg) | 139010200 | TTC7A | [ ] | [ ] | ['Multiple gastrointestinal atresias'] |
| NM_024809.4 (TCTN2):c.1506-2A>G | 374349989 | TCTN2 | [ ] | [ ] | ['Meckel syndrome type 8'] |
| NM_012275.2 (IL36RN):c.104A>G (p.Lys35Arg) | 187015338 | IL36RN | [ ] | [ ] | ['Pustular psoriasis, generalized'] |
| NM_178517.3 (PIGW):c.499A>G (p.Met167Val) | 200024253 | PIGW | [ ] | [ ] | ['Hyperphosphatasia with mental retardation syndrome 5'] |
| NM_015662.2 (IFT172):c.5179T>C (p.Cys1727Arg) | 149614625 | — | [ ] | [ ] | ['Short-rib thoracic dysplasia 10 with or without polydactyly'] |
| NM_000226.3 (KRT9):c.469A>G (p.Met157Val) | 58597584 | KRT9 | [ ] | [ ] | ['Epidermolytic palmoplantar keratoderma', 'not provided'] |
| NM_023073.3 (C5orf42):c.3290-2A>G | 606231260 | C5orf42 | [ ] | ['ATCYATCAAATA CAAAAATTTGG'] | ['Orofaciodigital syndrome 6'] |
| NM_005633.3 (SOS1):c.508A>G (p.Lys170Glu) | 397517172 | SOS1 | [ ] | [ ] | ['Noonan syndrome 4', 'Rasopathy', 'not provided'] |
| NM_006306.3 (SMC1A):c.3254A>G (p.Tyr1085Cys) | 587784418 | SMC1A | ['CTTAYAG ATCTCATC AATGTTGG'] | ['CTTAYAGATCTC ATCAATGTTGG'] | ['Congenital muscular hypertrophy-cerebral syndrome'] |
| NM_006218.2 (PIK3CA):c.1637A>G (p.Gln546Arg) | 397517201 | PIK3CA | [ ] | [ ] | ['Neoplasm of ovary'] |
| NM_006218.2 (PIK3CA):c.3073A>G (p.Thr1025Ala) | 397517202 | PIK3CA | [ ] | [ ] | ['Non-small cell lung cancer'] |
| NM_002354.2 (EPCAM):c.492-2A>G | 606231281 | EPCAM | [ ] | [ ] | ['Diarrhea 5, with tufting enteropathy, congenital'] |
| NM_033056.3 (PCDH15):c.1998-2A>G | 397517452 | PCDH15 | [ ] | [ ] | ['Usher syndrome, type 1F'] |
| NM_000301.3 (PLG):c.112A>G (p.Lys38Glu) | 73015965 | PLG | [ ] | [ ] | ['Plasminogen deficiency, type I'] |
| NM_000155.3 (GALT):c.424A>G (p.Met142Val) | 111033692 | GALT | [ ] | [ ] | ['Deficiency of UDPglucose-hexose-1-phosphate uridylyltransferase'] |
| NM_000096.3 (CP):c.2953A>G (p.Met985Val) | 386134132 | CP | [ ] | [ ] | ['Deficiency of ferroxidase'] |
| NM_000197.1 (HSD17B3):c.703A>G (p.Met235Val) | 119481074 | HSD17B3 | [ ] | [ ] | ['Testosterone 17-beta-dehydrogenase deficiency'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000197.1 (HSD17B3):c.389A>G (p.Asn130Ser) | 119481079 | HSD17B3 | [ ] | [ ] | ['Testosterone 17-beta-dehydrogenase deficiency'] |
| NM_015474.3 (SAMHD1):c.1106T>C (p.Leu369Ser) | 515726139 | SAMHD1 | [ ] | [ ] | ['Aicardi Goutieres syndrome 5'] |
| NM_004817.3 (TJP2):c.1992-2A>G | 587777521 | TJP2 | [ ] | ['CAGCTCYGAGA AGAAACCACGGG', 'TCAGCTCYGAGA AGAAACCACGG'] | ['Progressive familial intrahepatic cholestasis 4'] |
| NM_000257.3 (MYH7):c.617A>G (p.Lys206Arg) | 730880846 | MYH7 | [ ] | ['CTTCYTGCTGCG GTCCCCAATGG'] | ['Cardiomyopathy'] |
| NM_020919.3 (ALS2):c.2980-2A>G | 386134184 | ALS2 | [ ] | [ ] | ['Juvenile primary lateral sclerosis'] |
| m.10044A>G | 41362547 | MT-TG | [ ] | [ ] | ['Sudden death'] |
| NM_002977.3 (SCN9A):c.406A>G (p.Ile136Val) | 80356468 | SCN9A | [ ] | [ ] | ['Primary erythromelalgia'] |
| NM_001128425.1 (MUTYH):c.536A>G (p.Tyr179Cys) | 34612342 | MUTYH | [ ] | [ ] | ['MYH-associated polyposis', 'Hereditary cancer-predisposing syndrome', 'Endometrial carcinoma', 'Carcinoma of colon', 'not specified', 'not provided'] |
| NM_206933.2 (USH2A):c.12067-2A>G | 397517978 | USH2A | [ ] | ['TTCCCYGTAAGA AAATTAACAGG'] | ['Usher syndrome, type 2A', 'Retinitis pigmentosa 39'] |
| NM_000216.2 (ANOS1):c.1A>G (p.Met1Val) | 606231409 | ANOS1 | [ ] | ['GCACCAYGGCT GCGGGTCGAGGG', 'GGCACCAYGGCT GCGGGTCGAGG'] | ['Kallmann syndrome 1'] |
| NM_206933.2 (USH2A):c.1841-2A>G | 397518003 | USH2A | [ ] | [ ] | ['Usher syndrome, type 2A'] |
| NM_000368.4 (TSC1):c.1760A>G (p.Lys587Arg) | 118203576 | TSC1 | [ ] | [ ] | ['Tuberous sclerosis syndrome', 'Tuberous sclerosis 1', 'Hereditary cancer-predisposing syndrome', 'not specified'] |
| NM_021830.4 (C10orf2):c.1523A>G (p.Tyr508Cys) | 80356540 | C10orf2 | [ ] | [ ] | ['Mitochondrial DNA depletion syndrome 7 (hepatocerebral type)', 'not provided'] |
| NM_003334.3 (UBA1):c.1639A>G (p.Ser547Gly) | 80356546 | UBA1 | [ ] | ['TGGCYTGTCACC CGGATATGTGG'] | ['Arthrogryposis multiplex congenita, distal, X-linked'] |
| NM_206933.2 (USH2A):c.8559-2A>G | 397518039 | USH2A | ['ATCYAAA GCAAAAG ACAAGCAGG'] | ['ATCYAAAGCAA AAGACAAGCAGG'] | ['Retinitis pigmentosa', 'Usher syndrome, type 2A'] |
| NM_000038.5 (APC):c.1744-2A>G | 587783035 | APC | ['TCCYAGT AAGAAAC AGAATATGG'] | ['TCCYAGTAAGA AACAGAATATGG'] | ['Familial adenomatous polyposis 1'] |
| NM_194248.2 (OTOF):c.766-2A>G | 80356584 | OTOF | [ ] | ['GACCYGCAGGC AGGAGAAGGGGG', 'TGACCYGCAGGC AGGAGAAGGGG', 'CTGACCYGCAGG CAGGAGAAGGG', 'GCTGACCYGCAG GCAGGAGAAGG'] | ['Deafness, autosomal recessive 9'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000525.3 (KCNJ11):c.509A>G (p.Lys170Arg) | 80356621 | KCNJ11 | [ ] | [ ] | ['Permanent neonatal diabetes mellitus'] |
| NM_000352.4 (ABCC8):c.215A>G (p.Asn72Ser) | 80356634 | ABCC8 | [ ] | [ ] | ['Permanent neonatal diabetes mellitus'] |
| NM_000352.4 (ABCC8):c.4270A>G (p.Ile1424Val) | 80356653 | ABCC8 | [ ] | [ ] | ['Permanent neonatal diabetes mellitus'] |
| NM_000207.2 (INS):c.323A>G (p.Tyr108Cys) | 80356672 | — | [ ] | [ ] | ['Permanent neonatal diabetes mellitus'] |
| NM_000083.2 (CLCN1):c.382A>G (p.Met128Val) | 80356699 | CLCN1 | [ ] | [ ] | ['Myotonia congenita', 'Congenital myotonia, autosomal dominant form'] |
| NM_001008211.1 (OPTN):c.1433A>G (p.Glu478Gly) | 267606929 | OPTN | [ ] | [ ] | ['Amyotrophic lateral sclerosis type 12'] |
| NM_007375.3 (TARDBP):c.506A>G (p.Asp169Gly) | 80356717 | TARDBP | [ ] | [ ] | ['Amyotrophic lateral sclerosis type 10'] |
| NM_007375.3 (TARDBP):c.1009A>G (p.Met337Val) | 80356730 | TARDBP | [ ] | [ ] | ['Amyotrophic lateral sclerosis type 10'] |
| NM_007375.3 (TARDBP):c.1028A>G (p.Gln343Arg) | 80356731 | TARDBP | [ ] | [ ] | ['Amyotrophic lateral sclerosis type 10'] |
| NM_001701.3 (BAAT):c.967A>G (p.Ile323Val) | 80356747 | BAAT | ['CAAYGAA GAGGAATT GCCCCTGG'] | ['CAAYGAAGAGG AATTGCCCCTGG'] | ['Atypical hemolytic-uremic syndrome 1'] |
| NM_012463.3 (ATP6V0A2):c.732-2A>G | 80356753 | ATP6V0A2 | [ ] | [ ] | ['Cutis laxa with osteodystrophy'] |
| NM_001876.3 (CPT1A):c.1361A>G (p.Asp454Gly) | 80356778 | CPT1A | [ ] | [ ] | ['Carnitine palmitoyltransferase I deficiency'] |
| NM_001876.3 (CPT1A):c.1079A>G (p.Glu360Gly) | 80356787 | CPT1A | [ ] | [ ] | ['Carnitine palmitoyltransferase I deficiency'] |
| NM_001876.3 (CPT1A):c.1493A>G (p.Tyr498Cys) | 80356791 | CPT1A | [ ] | [ ] | ['Carnitine palmitoyltransferase I deficiency'] |
| NM_003159.2 (CDKL5):c.211A>G (p.Asn71Asp) | 587783072 | CDKL5 | [ ] | [ ] | ['Atypical Rett syndrome', 'not provided'] |
| NM_000257.3 (MYH7):c.1615A>G (p.Met539Val) | 730880930 | MYH7 | [ ] | ['GGAACAYGCAC TCCTCTTCCAGG'] | ['Cardiomyopathy'] |
| m.5843A>G | 118203894 | MT-TY | [ ] | [ ] | [ ] |
| NM_000130.4 (F5):c.1000A>G (p.Arg334Gly) | 118203905 | F5 | [ ] | [ ] | [ ] |
| NM_000130.4 (F5):c.5189A>G (p.Tyr1730Cys) | 118203907 | F5 | ['GTAGYAG GCCCAAGC CCGACAGG'] | ['GTAGYAGGCCC AAGCCCGACAGG'] | ['Factor V deficiency'] |
| NM_000052.6 (ATP7A):c.3911A>G (p.Asn1304Ser) | 151340632 | ATP7A | [ ] | [ ] | ['Menkes kinky-hair syndrome', 'Cutis laxa, X-linked'] |
| NM_007294.3 (BRCA1):c.5053A>G (p.Thr1685Ala) | 80356890 | BRCA1 | [ ] | [ ] | ['Familial cancer of breast', 'Breast-ovarian cancer, familial 1', 'Hereditary cancer-predisposing syndrome'] |
| NM_000046.3 (ARSB):c.629A>G (p.Tyr210Cys) | 118203943 | ARSB | [ ] | [ ] | ['Mucopolysaccharidosis type VI', 'not provided'] |
| NM_013319.2 | 118203945 | UBIAD1 | ['GTAAGTG | ['GTAAGTGYTGAC | ['Schnyder |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| (UBIAD1):c.305A>G (p.Asn102Ser) | | | ['TGACCAA ATTACCGG'] | CAAATTACCGG'] | crystalline corneal dystrophy'] |
| NM_013319.2 (UBIAD1):c.355A>G (p.Arg119Gly) | 118203947 | UBIAD1 | [ ] | ['TCCYGTCATCAC TCTTTTTGTGG'] | ['Schnyder crystalline corneal dystrophy'] |
| NM_013319.2 (UBIAD1):c.695A>G (p.Asn232Ser) | 118203949 | UBIAD1 | ['GGTGTTG YTGGAATG GAGAATGG'] | ['GGTGTTGYTGGA ATGGAGAATGG'] | ['Schnyder crystalline corneal dystrophy'] |
| NM_013319.2 (UBIAD1):c.335A>G (p.Asp112Gly) | 118203950 | UBIAD1 | [ ] | [ ] | ['Schnyder crystalline corneal dystrophy'] |
| NM_024334.2 (TMEM43):c.271A>G (p.Ile91Val) | 144811578 | TMEM43 | [ ] | [ ] | ['Emery-Dreifuss muscular dystrophy 7, autosomal dominant', 'not provided'] |
| NM_012073.4 (CCT5):c.440A>G (p.His147Arg) | 118203986 | CCT5 | [ ] | [ ] | ['Neuropathy, hereditary sensory, with spastic paraplegia, autosomal recessive'] |
| NM_000033.3 (ABCD1):c.443A>G (p.Asn148Ser) | 128624216 | ABCD1 | ['CACTGYT GACGAAG GTAGCAGG G'] | ['CACTGYTGACGA AGGTAGCAGGG', 'GCACTGYTGACG AAGGTAGCAGG'] | ['Adrenoleukodystrophy'] |
| NM_000146.3 (FTL):c.1A>G (p.Met1Val) | 139732572 | FTL | ['CTCAYGG TTGGTTGG CAAGAAGG'] | ['CTCAYGGTTGGT TGGCAAGAAGG'] | ['L-ferritin deficiency'] |
| NM_000785.3 (CYP27B1):c.566A>G (p.Glu189Gly) | 118204012 | CYP27B1 | [ ] | [ ] | ['Vitamin D-dependent rickets, type 1'] |
| NM_000252.2 (MTM1):c.1261-10A>G | 397518445 | MTM1 | [ ] | [ ] | ['Severe X-linked myotubular myopathy'] |
| NM_139281.2 (WDR36):c.1064A>G (p.Asn355Ser) | 118204022 | WDR36 | [ ] | [ ] | ['Glaucoma 1, open angle, G'] |
| NM_000392.4 (ABCC2):c.4145A>G (p.Gln1382Arg) | 72558202 | ABCC2 | [ ] | [ ] | ['Dubin-Johnson syndrome'] |
| NM_000165.4 (GJA1):c.617A>G (p.Lys206Arg) | 397518464 | GJA1 | [ ] | [ ] | ['Oculodentodigital dysplasia'] |
| NM_000833.4 (GRIN2A):c.1123-2A>G | 397518469 | GRIN2A | [ ] | [ ] | ['Focal epilepsy with speech disorder with or without mental retardation'] |
| NM_015702.2 (MMADHC):c.746A>G (p.Tyr249Cys) | 118204046 | MMADHC | [ ] | [ ] | ['Homocystinuria, cblD type, variant 1'] |
| NM_000526.4 (KRT14):c.368A>G (p.Asn123Ser) | 60171927 | KRT14 | [ ] | ['GCGGTCAYTGA GGTTCTGCATGG'] | ['Epidermolysis bullosa herpetiformis, Dowling-Meara', 'not provided'] |
| NM_000237.2 (LPL):c.548A>G (p.Asp183Gly) | 118204064 | LPL | ['AGCTGGA YCGAGGCC TTAAAAGG'] | ['GCTGGAYCGAG GCCTTAAAAGGG', 'AGCTGGAYCGAG GCCTTAAAAGG'] | ['Hyperlipoproteinemia, type I'] |
| NM_016247.3 (IMPG2):c.370T>C (p.Phe124Leu) | 201893545 | IMPG2 | ['ACTYTTT GGGATCGA CTTCCTGG'] | ['ACTYTTTGGGAT CGACTTCCTGG'] | ['Macular dystrophy, vitelliform, 5'] |
| NM_004035.6 (ACOX1):c.832A>G (p.Met278Val) | 118204090 | ACOX1 | [ ] | [ ] | ['Pseudoneonatal adrenoleukodystrophy'] |
| NM_004035.6 (ACOX1):c.926A>G (p.Gln309Arg) | 118204092 | ACOX1 | [ ] | [ ] | ['Pseudoneonatal adrenoleukodystrophy'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000190.3 (HMBS):c.1A>G (p.Met1Val) | 118204118 | HMBS | [ ] | [ ] | ['Porphyria, acute intermittent, nonerythroid variant'] |
| NM_001363.4 (DKC1):c.941A>G (p.Lys314Arg) | 199422248 | DKC1 | [ ] | ['AATCYTGGCCCC ATAGCAGATGG'] | ['Dyskeratosis congenita X-linked'] |
| NM_000078.2 (CETP):c.1376A>G (p.Asp459Gly) | 2303790 | CETP | [ ] | [ ] | ['Hyperalphalipo-proteinemia'] |
| NM_000531.5 (OTC):c.595A>G (p.Asn199Asp) | 72558405 | OTC | [ ] | [ ] | ['not provided'] |
| NM_000531.5 (OTC):c.596A>G (p.Asn199Ser) | 72558406 | OTC | [ ] | [ ] | ['not provided'] |
| NM_000531.5 (OTC):c.613A>G (p.Met205Val) | 72558411 | OTC | [ ] | [ ] | ['not provided'] |
| NM_000531.5 (OTC):c.717+3A>G | 72558432 | OTC | [ ] | [ ] | ['not provided'] |
| NM_000531.5 (OTC):c.718-2A>G | 72558433 | OTC | [ ] | [ ] | ['not provided'] |
| NM_000531.5 (OTC):c.788A>G (p.Asp263Gly) | 72558443 | OTC | [ ] | [ ] | ['not provided'] |
| NM_000531.5 (OTC):c.790A>G (p.Thr264Ala) | 72558444 | OTC | [ ] | [ ] | ['not provided'] |
| NM_000531.5 (OTC):c.929A>G (p.Glu310Gly) | 72558467 | OTC | [ ] | ['TCCACTYCTTCT GGCTTTCTGGG', 'ATCCACTYCTTCT GGCTTTCTGG'] | ['not provided'] |
| NM_000531.5 (OTC):c.988A>G (p.Arg330Gly) | 72558478 | OTC | [ ] | ['ACTTTCYGTTTT CTGCCTCTGGG', 'CACTTTCYGTTTT CTGCCTCTGG'] | ['not provided'] |
| NM_000488.3 (SERPINC1):c.655A>G (p.Asn219Asp) | 121909571 | SERPINC1 | [ ] | [ ] | ['Antithrombin III deficiency'] |
| NM_007294.3 (BRCA1):c.122A>G (p.His41Arg) | 80357276 | BRCA1 | ['AAATATG YGGTCACA CTTTGTGG'] | ['AAATATGYGGTC ACACTTTGTGG'] | ['Familial cancer of breast', 'Breast-ovarian cancer, familial 1'] |
| NM_007294.3 (BRCA1):c.1A>G (p.Met1Val) | 80357287 | BRCA1 | [ ] | [ ] | ['Familial cancer of breast', 'Breast-ovarian cancer, familial 1', 'Hereditary cancer-predisposing syndrome'] |
| NM_198056.2 (SCN5A):c.1134T>A (p.Tyr378Ter) | 373172185 | SCN5A | [ ] | [ ] | ['not provided'] |
| m.7526A>G | 121434454 | MT-TD | [ ] | [ ] | [ ] |
| NM_007294.3 (BRCA1):c.211A>G (p.Arg71Gly) | 80357382 | BRCA1 | [ ] | [ ] | ['Familial cancer of breast', 'Hereditary breast and ovarian cancer syndrome', 'Breast-ovarian cancer, familial 1', 'Hereditary cancer-predisposing syndrome'] |
| NM_000512.4 (GALNS):c.1460A>G (p.Asn487Ser) | 118204440 | GALNS | ['ACGYTGA GCTGGGGC TGCGCGGG', 'CACGYTG AGCTGGGG CTGCGCGG'] | ['ACGYTGAGCTG GGGCTGCGCGGG', 'CACGYTGAGCTG GGGCTGCGCGG'] | ['Mucopolysaccharidosis, MPS-IV-A'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000505.3 (F12):c.158A>G (p.Tyr53Cys) | 118204455 | F12 | [ ] | ['GGTGGYACTGG AAGGGGAAGTGG'] | [ ] |
| NM_007294.3 (BRCA1):c.5453A>G (p.Asp1818Gly) | 80357477 | BRCA1 | [ ] | ['TTGYCCTCTGTC CAGGCATCTGG'] | ['Familial cancer of breast', 'Breast-ovarian cancer, familial 1'] |
| NM_032492.3 (JAGN1):c.485A>G (p.Gln162Arg) | 587777730 | JAGN1 | [ ] | [ ] | ['Severe congenital neutropenia', 'Severe congenital neutropenia 6, autosomal recessive'] |
| NM_000257.3 (MYH7):c.2087A>G (p.Asn696Ser) | 730880732 | MYH7 | [ ] | [ ] | ['Cardiomyopathy'] |
| NM_000430.3 (PAFAH1B1):c.446A>G (p.His149Arg) | 121434482 | PAFAH1B1 | [ ] | [ ] | ['Lissencephaly 1'] |
| NM_000363.4 (TNNI3):c.547A>G (p.Lys183Glu) | 730881077 | TNNI3 | [ ] | [ ] | ['Cardiomyopathy'] |
| NM_018105.2 (THAP1):c.266A>G (p.Lys89Arg) | 267607111 | THAP1 | [ ] | [ ] | ['Dystonia 6, torsion'] |
| NM_016599.4 (MYOZ2):c.738A>G (p.Ile246Met) | 140126678 | MYOZ2 | [ ] | [ ] | ['Familial hypertrophic cardiomyopathy 16', 'not specified', 'not provided'] |
| NM_000161.2 (GCH1):c.671A>G (p.Lys224Arg) | 41298442 | GCH1 | [ ] | [ ] | ['Dystonia 5, Dopa-responsive type', 'Dystonia, dopa-responsive, with or without hyperphenylalaninemia, autosomal recessive'] |
| NM_017415.2 (KLHL3):c.926A>G (p.Gln309Arg) | 199469627 | KLHL3 | | | ['Pseudohypo-aldosteronism, type 2'] |
| NM_017415.2 (KLHL3):c.1670A>G (p.Tyr557Cys) | 199469645 | KLHL3 | | | ['Pseudohypo-aldosteronism, type 2', 'Pseudohypo aldosteronism type 2D'] |
| NM_003590.4 (CUL3):c.1207-26A>G | 199469650 | CUL3 | | | ['Pseudohypo-aldosteronism, type 2'] |
| NM_003590.4 (CUL3):c.1238A>G (p.Asp413Gly) | 199469656 | CUL3 | | | ['Pseudohypo-aldosteronism, type 2', 'Pseudohypo-aldosteronism type 2E'] |
| NM_003590.4 (CUL3):c.1376A>G (p.Lys459Arg) | 199469658 | CUL3 | | | ['Pseudohypo-aldosteronism, type 2'] |
| NM_003590.4 (CUL3):c.1377+3A>G | 199469661 | CUL3 | | | ['Pseudohypo-aldosteronism, type 2'] |
| NM_007294.3 (BRCA1):c.4096+3A>G | 80358015 | BRCA1 | [ ] | [ ] | ['Hereditary breast and ovarian cancer syndrome', 'Breast-ovarian cancer, familial 1', 'Hereditary cancer-predisposing syndrome'] |
| NM_007294.3 (BRCA1):c.135-2A>G | 80358065 | BRCA1 | [ ] | [ ] | ['Breast-ovarian cancer, familial 1'] |
| NM_024426.4 (WT1):c.1391A>G (p.Asp464Gly) | 121907902 | WT1 | [ ] | [ ] | ['Drash syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_007294.3 (BRCA1):c.212+3A>G | 80358083 | BRCA1 | [ ] | [ ] | ['Familial cancer of breast', 'Breast-ovarian cancer, familial 1'] |
| NM_024426.4 (WT1):c.1021A>G (p.Ser341Gly) | 121907908 | WT1 | [ ] | ['CGCYCTCGTACC CTGTGCTGTGG'] | ['Mesothelioma'] |
| NM_007294.3 (BRCA1):c.4676-2A>G | 80358096 | BRCA1 | [ ] | [ ] | ['Breast-ovarian cancer, familial 1', 'Hereditary cancer-predisposing syndrome'] |
| NM_000280.4 (PAX6):c.1171A>G (p.Thr391Ala) | 121907926 | PAX6 | [ ] | ['GTGGYGCCCGA GGTGCCCATTGG'] | ['Optic nerve aplasia, bilateral'] |
| NM_000520.4 (HEXA):c.611A>G (p.His204Arg) | 121907976 | HEXA | [ ] | [ ] | ['Tay-Sachs disease'] |
| NM_000159.3 (GCDH):c.1213A>G (p.Met405Val) | 141437721 | GCDH | [ ] | [ ] | ['Glutaric aciduria, type 1'] |
| NM_024740.2 (ALG9):c.860A>G (p.Tyr287Cys) | 121908023 | ALG9 | [ ] | ['TTAYACAAAAC AATGTTGAGTGG'] | ['Congenital disorder of glycosylation type 1L'] |
| NM_003051.3 (SLC16A1):c.610A>G (p.Lys204Glu) | 80358222 | SLC16A1 | [ ] | [ ] | ['Erythrocyte lactate transporter defect'] |
| NM_000229.1 (LCAT):c.463A>G (p.Asn155Asp) | 121908057 | LCAT | [ ] | [ ] | ['Fish-eye disease'] |
| NM_000639.2 (FASLG):c.466A>G (p.Arg156Gly) | 80358238 | FASLG | [ ] | [ ] | ['Autoimmune lymphoproliferative syndrome'] |
| NM_001369.2 (DNAH5):c.1121T>C (p.Ile374Thr) | 147499872 | DNAH5 | [ ] | [ ] | ['Ciliary dyskinesia, primary, 3'] |
| NM_138691.2 (TMC1):c.1960A>G (p.Met654Val) | 121908074 | TMC1 | [ ] | [ ] | ['Deafness, autosomal recessive 7'] |
| NM_024301.4 (FKRP):c.1387A>G (p.Asn463Asp) | 121908110 | FKRP | [ ] | [ ] | ['Congenital muscular dystrophy-dystroglycanopathy (with or without mental retardation) type B5', 'Limb-girdle muscular dystrophy-dystroglycanopathy, type C5', 'Muscular dystrophy', 'Congenital muscular dystrophy-dystroglycanopathy with brain and eye anomalies type A5', 'Congenital muscular dystrophy-dystroglycanopathy without mental retardation, type B5', 'not provided'] |
| NM_175073.2 (APTX):c.602A>G (p.His201Arg) | 121908133 | APTX | ['GCCAAYG GTAACGGG CCTTTGGG'] | ['GCCAAYGGTAA CGGGCCTTTGGG', 'AGCCAAYGGTAA CGGGCCTTTGG'] | ['Adult onset ataxia with oculomotor apraxia'] |
| NM_001243133.1 (NLRP3):c.1880A>G (p.Glu627Gly) | 121908148 | NLRP3 | [ ] | ['ACAATYCCAGCT GGCTGGGCTGG'] | ['Familial cold urticaria'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_006492.2 (ALX3):c.608A>G (p.Asn203Ser) | 121908166 | ALX3 | [ ] | ['CGGYTCTGGAAC CAGACCTGGGG', 'GCGGYTCTGGAA CCAGACCTGGG', 'TGCGGYTCTGGA ACCAGACCTGG'] | ['Frontonasal dysplasia 1'] |
| NM_020451.2 (SEPN1):c.1A>G (p.Met1Val) | 121908184 | SEPN1 | [ ] | ['CCCAYGGCTGCG GCTGGCGGCGG', 'CGGCCCAYGGCT GCGGCTGGCGG'] | ['Eichsfeld type congenital muscular dystrophy'] |
| NM_001127221.1 (CACNA1A):c.4151A>G (p.Tyr1384Cys) | 121908219 | CACNA1A | [ ] | [ ] | ['Familial hemiplegic migraine type 1'] |
| NM_005249.4 (FOXG1):c.686T>A (p.Ile229Asn) | 199502880 | FOXG1 | [ ] | [ ] | ['not provided'] |
| NM_130468.3 (CHST14):c.878A>G (p.Tyr293Cys) | 121908258 | CHST14 | [ ] | ['AAGTCAYAGTG CACGGCACAAGG'] | ['Ehlers-Danlos syndrome, musculocontractural type'] |
| NM_013391.3 (DMGDH):c.326A>G (p.His109Arg) | 121908331 | DMGDH | [ ] | [ ] | ['Dimethylglycine dehydrogenase deficiency'] |
| NM_015166.3 (MLC1):c.422A>G (p.Asn141Ser) | 121908344 | MLC1 | [ ] | [ ] | ['Megalencephalic leukoencephalopathy with subcortical cysts 1'] |
| NM_000441.1 (SLC26A4):c.1105A>G (p.Lys369Glu) | 121908361 | SLC26A4 | [ ] | [ ] | ['Enlarged vestibular aqueduct syndrome'] |
| NM_000441.1 (SLC26A4):c.2168A>G (p.His723Arg) | 121908362 | SLC26A4 | [ ] | [ ] | ['Pendred syndrome', 'Enlarged vestibular aqueduct syndrome'] |
| NM_015560.2 (OPA1):c.1745A>G (p.Tyr582Cys) | 121908376 | OPA1 | [ ] | [ ] | ['Optic Atrophy Type 1'] |
| NM_001128425.1 (MUTYH):c.1241A>G (p.Gln414Arg) | 121908383 | MUTYH | [ ] | ['AAGCYGCTCTGA GGGCTCCCAGG'] | ['Neoplasm of stomach'] |
| NM_015247.2 (CYLD):c.2240A>G (p.Glu747Gly) | 121908389 | CYLD | [ ] | [ ] | ['Familial multiple trichoepitheliomata', 'Spiegler-Brooke syndrome'] |
| NM_021102.3 (SPINT2):c.488A>G (p.Tyr163Cys) | 121908403 | SPINT2 | ['TCCAYAG ATGAAGTT ATTGCAGG'] | ['TCCAYAGATGA AGTTATTGCAGG'] | ['Diarrhea 3, secretory sodium, congenital, syndromic'] |
| NM_004924.4 (ACTN4):c.763A>G (p.Lys255Glu) | 121908415 | ACTN4 | [ ] | [ ] | ['Focal segmental glomerulosclerosis 1'] |
| NM_004795.3 (KL):c.578A>G (p.His193Arg) | 121908423 | KL | ['CAGYGGT ACAGGGTG ACCACGGG', 'CCAGYGG TACAGGGT GACCACGG'] | ['CAGYGGTACAG GGTGACCACGGG', 'CCAGYGGTACAG GGTGACCACGG'] | [ ] |
| NM_005682.6 (ADGRG1):c.263A>G (p.Tyr88Cys) | 121908466 | ADGRG1 | ['TGGYAGA GGCCCCTG GGGTCAGG'] | ['TGGYAGAGGCC CCTGGGGTCAGG'] | ['Polymicrogyria, bilateral frontoparietal'] |
| NM_139025.4 (ADAMTS13):c.1582A>G (p.Arg528Gly) | 121908473 | ADAMTS13 | [ ] | [ ] | ['Upshaw-Schulman syndrome'] |
| NM_014270.4 (SLC7A9):c.695A>G (p.Tyr232Cys) | 121908487 | SLC7A9 | [ ] | [ ] | ['Cystinuria'] |
| NM_004211.3 (SLC6A5):c.1472A>G (p.Tyr491Cys) | 121908494 | SLC6A5 | [ ] | [ ] | ['Hyperekplexia 3'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_004211.3 (SLC6A5):c.1526A>G (p.Asn509Ser) | 121908497 | SLC6A5 | [ ] | [ ] | ['Hyperekplexia 3'] |
| NM_182643.2 (DLC1):c.2875A>G (p.Thr959Ala) | 121908500 | DLC1 | [ ] | [ ] | ['Carcinoma of colon'] |
| NM_014946.3 (SPAST):c.1322A>G (p.Asp441Gly) | 121908512 | SPAST | [ ] | [ ] | ['Spastic paraplegia 4, autosomal dominant'] |
| NM_014946.3 (SPAST):c.1157A>G (p.Asn386Ser) | 121908514 | SPAST | [ ] | [ ] | ['Spastic paraplegia 4, autosomal dominant'] |
| NM_000026.2 (ADSL):c.736A>G (p.Lys246Glu) | 119450944 | ADSL | [ ] | [ ] | ['Adenylosuccinate lyase deficiency'] |
| NM_000334.4 (SCN4A):c.3478A>G (p.Ile1160Val) | 121908549 | SCN4A | ['TGAYGGA GGGGATGG CGCCTAGG'] | ['TGAYGGAGGGG ATGGCGCCTAGG'] | [ ] |
| NM_000334.4 (SCN4A):c.421A>G (p.Ile141Val) | 121908561 | SCN4A | [ ] | [ ] | ['Paramyotonia congenita of von Eulenburg'] |
| NM_004328.4 (BCS1L):c.148A>G (p.Thr50Ala) | 121908580 | BCS1L | [ ] | ['GTGYGATCATGT AATGGCGCCGG'] | ['Mitochondrial complex III deficiency'] |
| NM_152384.2 (BBS5):c.547A>G (p.Thr183Ala) | 121908582 | BBS5 | [ ] | [ ] | ['Bardet-Biedl syndrome 5'] |
| NM_016417.2 (GLRX5):c.294A>G (p.Gln98=) | 121908584 | GLRX5 | [ ] | ['CCTGACCYTGTC GGAGCTCCGGG'] | ['Anemia, sideroblastic, pyridoxine-refractory, autosomal recessive'] |
| NM_006206.4 (PDGFRA):c.1664A>G (p.Tyr555Cys) | 121908589 | PDGFRA | [ ] | [ ] | [ ] |
| NM_002755.3 (MAP2K1):c.389A>G (p.Tyr130Cys) | 121908595 | MAP2K1 | ['CCAYAGA AGCCCACG ATGTACGG'] | ['CCAYAGAAGCC CACGATGTACGG'] | ['Cardiofaciocutaneous syndrome 3', 'Rasopathy'] |
| NM_012082.3 (ZFPM2):c.89A>G (p.Glu30Gly) | 121908601 | ZFPM2 | [ ] | [ ] | ['Double outlet right ventricle', 'Tetralogy of Fallot', 'Diaphragmatic hernia 3'] |
| NM_012082.3 (ZFPM2):c.2527A>G (p.Thr843Ala) | 121908604 | — | [ ] | [ ] | ['Diaphragmatic hernia 3'] |
| NM_022817.2 (PER2):c.1984A>G (p.Ser662Gly) | 121908635 | PER2 | [ ] | ['GCCACACYCTCT GCCTTGCCCGG'] | ['Advanced sleep phase syndrome, familial'] |
| NM_030761.4 (WNT4):c.647A>G (p.Glu216Gly) | 121908650 | WNT4 | [ ] | [ ] | ['Mullerian aplasia and hyperandrogenism'] |
| NM_003839.3 (TNFRSF11A):c.508A>G (p.Arg170Gly) | 121908655 | TNFRSF11A | [ ] | ['GGGTCYGCATTT GTCCGTGGAGG'] | ['Osteopetrosis autosomal recessive 7'] |
| NM_000539.3 (RHO):c.886A>G (p.Lys296Glu) | 29001653 | RHO | [ ] | ['CGCTCTYGGCAA AGAACGCTGGG', 'GCGCTCTYGGCA AAGAACGCTGG'] | ['Retinitis pigmentosa 4'] |
| NM_004006.2 (DMD):c.2317A>G (p.Lys773Glu) | 128626244 | DMD | [ ] | [ ] | ['Duchenne muscular dystrophy'] |
| NM_003722.4 (TP63):c.697A>G (p.Lys233Glu) | 121908838 | TP63 | ['AGCTTYT TTGTAGAC AGGCATGG'] | ['AGCTTYTTTGTA GACAGGCATGG'] | ['Split-hand/foot malformation 4'] |
| NM_003722.4 (TP63):c.1052A>G (p.Asp351Gly) | 121908844 | TP63 | [ ] | [ ] | ['Ectrodactyly, ectodermal dysplasia, and cleft lip/palate syndrome 3'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_003722.4 (TP63):c.1054A>G (p.Arg352Gly) | 121908847 | TP63 | [ ] | [ ] | ['ADULT syndrome', 'Orofacial cleft 8'] |
| NM_000369.2 (TSHR):c.1856A>G (p.Asp619Gly) | 121908859 | TSHR | [ ] | [ ] | ['Thyroid adenoma, hyperfunctioning'] |
| NM_000369.2(TSHR): c.548A>G (p.Lys183Arg) | 121908879 | TSHR | [ ] | [ ] | ['Hyperthyroidism, familial gestational'] |
| NM_003060.3 (SLC22A5):c.632A>G (p.Tyr211Cys) | 121908888 | SLC22A5 | [ ] | [ ] | ['Renal carnitine transport defect', 'not provided'] |
| NM_006502.2 (POLH):c.1603A>G (p.Lys535Glu) | 56307355 | POLH | [ ] | ['AGACTTTYCTGC TTAAAGAAGGG'] | ['Xeroderma pigmentosum, variant type'] |
| NM_002977.3 (SCN9A):c.1964A>G (p.Lys655Arg) | 121908919 | — | [ ] | ['CCTTTTCYTGTG TATTTGATTGG'] | ['Generalized epilepsy with febrile seizures plus, type 7', 'not specified'] |
| NM_002977.3 (SCN9A):c.184A>G (p.Ile62Val) | 121908920 | SCN9A | [ ] | [ ] | ['Febrile seizures, familial, 3b'] |
| NM_006892.3 (DNMT3B):c.2450A>G (p.Asp817Gly) | 121908939 | DNMT3B | [ ] | ['GACACGYCTGTG TAGTGCACAGG'] | ['Centromeric instability of chromosomes 1,9 and 16 and immunodeficiency'] |
| NM_001130978.1 (DYSF):c.3892A>G (p.Ile1298Val) | 121908954 | DYSF | [ ] | [ ] | ['Miyoshi muscular dystrophy 1', 'Limb-girdle muscular dystrophy, type 2B', 'not specified'] |
| NM_001130978.1 (DYSF):c.5264A>G (p.Glu1755Gly) | 121908961 | DYSF | [ ] | [ ] | ['Limb-girdle muscular dystrophy, type 2B'] |
| NM_016203.3 (PRKAG2):c.1148A>G (p.His383Arg) | 121908988 | PRKAG2 | [ ] | [ ] | ['Familial hypertrophic cardiomyopathy 6'] |
| NM_000492.3 (CFTR):c.2738A>G (p.Tyr913Cys) | 121909008 | CFTR | ['CACATAA YACGAACT GGTGCTGG'] | ['CACATAAYACG AACTGGTGCTGG'] | ['Cystic fibrosis'] |
| NM_000492.3 (CFTR):c.326A>G (p.Tyr109Cys) | 121909031 | CFTR | [ ] | [ ] | ['Cystic fibrosis'] |
| NM_000492.3 (CFTR):c.650A>G (p.Glu217Gly) | 121909046 | CFTR | [ ] | [ ] | ['Cystic fibrosis'] |
| NM_001040667.2 (HSF4):c.256A>G (p.Ile86Val) | 121909050 | HSF4 | [ ] | [ ] | ['Cataract, zonular'] |
| NM_005025.4 (SERPINI1):c.1013A>G (p.His338Arg) | 121909052 | SERPINI1 | [ ] | [ ] | ['Familial encephalopathy with neuroserpin inclusion bodies'] |
| NM_005422.2 (TECTA):c.5609A>G (p.Tyr1870Cys) | 121909058 | TECTA | [ ] | [ ] | ['Deafness, autosomal dominant 12'] |
| NM_170695.3 (TGIF1):c.838A>G (p.Thr280Ala) | 121909068 | TGIF1 | [ ] | [ ] | ['Holoprosencephaly 4'] |
| NM_001005360.2 (DNM2):c.1684A>G (p.Lys562Glu) | 121909088 | DNM2 | [ ] | ['ACTYCTTCTCTT TCTCCTGAGGG', 'TACTYCTTCTCTT TCTCCTGAGG'] | ['Charcot-Marie-Tooth disease, dominant intermediate b, with neutropenia'] |
| NM_000483.4 (APOC2):c.1A>G (p.Met1Val) | 120074112 | — | [ ] | ['GCCCAYAGTGTC CAGAGACCTGG'] | ['Apolipoprotein C2 deficiency'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000543.4 (SMPD1):c.1154A>G (p.Asn385Ser) | 120074123 | SMPD1 | [ ] | [ ] | ['Niemann-Pick disease, type B'] |
| NM_000019.3 (ACAT1):c.278A>G (p.Asn93Ser) | 120074145 | ACAT1 | [ ] | [ ] | ['Deficiency of acetyl-CoA acetyltransferase'] |
| NM_138477.2 (CDAN1):c.1796A>G (p.Asn599Ser) | 120074166 | CDAN1 | [ ] | [ ] | ['Congenital dyserythropoietic anemia, type I'] |
| NM_000187.3 (HGD):c.1102A>G (p.Met368Val) | 120074173 | HGD | [ ] | [ ] | ['Alkaptonuria'] |
| NM_001089.2 (ABCA3):c.1702A>G (p.Asn568Asp) | 121909184 | ABCA3 | ['ACCGTYG TGGCCCAG CAGGACGG'] | ['ACCGTYGTGGCC CAGCAGGACGG'] | ['Surfactant metabolism dysfunction, pulmonary, 3'] |
| NM_000503.5 (EYA1):c.1639A>G (p.Arg547Gly) | 121909197 | EYA1 | [ ] | [ ] | [ ] |
| NM_000218.2 (KCNQ1):c.418A>G (p.Ser140Gly) | 120074192 | KCNQ1 | ['CGCYGAA GATGAGGC AGACCAGG'] | ['CGCYGAAGATG AGGCAGACCAGG'] | ['Atrial fibrillation, familial, 3', 'Atrial fibrillation'] |
| NM_000314.6 (PTEN):c.368A>G (p.His123Arg) | 121909222 | PTEN | [ ] | [ ] | ['Cowden syndrome 1'] |
| NM_000314.6 (PTEN):c.278A>G (p.His93Arg) | 121909238 | PTEN | [ ] | [ ] | ['Hereditary cancer-predisposing syndrome', 'Macrocephaly/autism syndrome'] |
| NM_000314.6 (PTEN):c.755A>G (p.Asp252Gly) | 121909239 | PTEN | [ ] | ['ATAYCACCACAC ACAGGTAACGG'] | ['Macrocephaly/autism syndrome'] |
| NM_198217.2 (ING1):c.515A>G (p.Asn172Ser) | 121909251 | ING1 | [ ] | ['TGGYTGCACAG ACAGTACGTGGG', 'CTGGYTGCACAG ACAGTACGTGG'] | ['Squamous cell carcinoma of the head and neck'] |
| NM_012338.3 (TSPAN12):c.734T>C (p.Leu245Pro) | 200519776 | TSPAN12 | [ ] | [ ] | ['Exudative vitreoretinopathy 5'] |
| NM_001001557.2 (GDF6):c.1271A>G (p.Lys424Arg) | 121909353 | GDF6 | [ ] | [ ] | ['Klippel-Feil syndrome 1, autosomal dominant'] |
| NM_000163.4 (GHR):c.594A>G (p.Glu198=) | 121909360 | GHR | [ ] | [ ] | ['Laron-type isolated somatotropin defect'] |
| NM_000256.3 (MYBPC3):c.175A>G (p.Thr59Ala) | 121909375 | MYBPC3 | [ ] | [ ] | ['Familial hypertrophic cardiomyopathy 4'] |
| NM_001174089.1 (SLC4A11):c.2518A>G (p.Met840Val) | 121909396 | SLC4A11 | [ ] | ['GATCAYCTTCAT GTAGGGCAGG', 'AGATCAYCTTCA TGTAGGGCAGG'] | ['Corneal dystrophy and perceptive deafness'] |
| NM_001100.3 (ACTA1):c.350A>G (p.Asn117Ser) | 121909520 | ACTA1 | ['GCGGYTG GCCTTGGG ATTGAGGG', 'CGCGGYT GGCCTTGG GATTGAGG'] | ['CGGYTGGCCTTG GGATTGAGGGG', 'GCGGYTGGCCTT GGGATTGAGGG', 'CGCGGYTGGCCT TGGGATTGAGG'] | ['Nemaline myopathy 3'] |
| NM_000034.3 (ALDOA):c.386A>G (p.Asp129Gly) | 121909533 | ALDOA | [ ] | ['CCAYCCAACCCT AAGAGAAGAGG'] | ['HNSHA due to aldolase A deficiency'] |
| NM_000495.4 (COL4A5):c.3455-9A>G | 104886388 | COL4A5 | [ ] | [ ] | ['Alport syndrome, X-linked recessive'] |
| NM_001145.4 (ANG):c.208A>G (p.Ile70Val) | 121909541 | — | [ ] | [ ] | ['Amyotrophic lateral sclerosis type 9'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000051.3 (ATM):c.3118A>G (p.Met1040Val) | 3092857 | ATM | [ ] | [ ] | ['Hereditary cancer-predisposing syndrome', 'not specified'] |
| NM_023110.2 (FGFR1):c.1121A>G (p.Tyr374Cys) | 121909631 | FGFR1 | [ ] | [ ] | ['Osteoglophonic dysplasia'] |
| NM_182925.4 (FLT4):c.3104A>G (p.His1035Arg) | 121909653 | FLT4 | ['CTGYGGATGCACTGGGGTGCGGG', 'TCTGYGGATGCACTGGGGTGCGG'] | ['CTGYGGATGCACTGGGGTGCGGG', 'TCTGYGGATGCACTGGGGTGCGG'] | [ ] |
| NM_000145.3 (FSHR):c.1345A>G (p.Thr449Ala) | 121909663 | FSHR | [ ] | [ ] | ['Ovarian hyperstimulation syndrome'] |
| NM_001017420.2 (ESCO2):c.1132-7A>G | 80359862 | ESCO2 | [ ] | [ ] | ['Roberts-SC phocomelia syndrome'] |
| NM_001017420.2 (ESCO2):c.1674-2A>G | 80359869 | ESCO2 | [ ] | [ ] | ['Roberts-SC phocomelia syndrome'] |
| NM_024577.3 (SH3TC2):c.505T>C (p.Tyr169His) | 80359890 | SH3TC2 | [ ] | [ ] | ['Charcot-Marie-Tooth disease, type 4C', 'Charcot-Marie-Tooth disease, type IV', 'Mononeuropathy of the median nerve, mild'] |
| NM_032119.3 (ADGRV1):c.18131A>G (p.Tyr6044Cys) | 121909763 | ADGRV1 | [ ] | [ ] | ['Usher syndrome, type 2C'] |
| NM_001360.2 (DHCR7):c.839A>G (p.Tyr280Cys) | 121909766 | DHCR7 | [ ] | [ ] | ['Smith-Lemli-Opitz syndrome'] |
| NM_000517.4 (HBA2):c.1A>G (p.Met1Val) | 121909803 | HBA2 | [ ] | [ ] | ['Hemoglobin H disease, nondeletional'] |
| NM_004006.2 (DMD):c.835A>G (p.Thr279Ala) | 128627255 | DMD | [ ] | ['TGACCGYGATCTGCAGAGAAGGG', 'CTGACCGYGATCTGCAGAGAAGG'] | ['Dilated cardiomyopathy 3B'] |
| NM_015896.3 (ZMYND10):c.797T>C (p.Leu266Pro) | 200913791 | ZMYND10 | [ ] | [ ] | ['Kartagener syndrome', 'Ciliary dyskinesia, primary, 22'] |
| NM_001085.4 (SERPINA3):c.1240A>G (p.Met414Val) | 116929575 | SERPINA3 | [ ] | ['GCTCAYGAAGAAGATGTTCTGGG', 'TGCTCAYGAAGAAGATGTTCTGG'] | [ ] |
| NM_058216.2 (RAD51C):c.1027-2A>G | 587780835 | RAD51C | [ ] | [ ] | ['Fanconi anemia, complementation group O'] |
| NM_006231.3 (POLE):c.4444+3A>G | 398122515 | POLE | [ ] | [ ] | ['Facial dysmorphism, immunodeficiency, livedo, and short stature'] |
| NM_002769.4 (PRSS1):c.161A>G (p.Asn54Ser) | 144422014 | — | [ ] | [ ] | ['Hereditary pancreatitis'] |
| NM_001204316.1 (PRLR):c.635A>G (p.His212Arg) | 398122522 | PRLR | [ ] | [ ] | ['Hyperprolactinemia'] |
| NM_004992.3 (MECP2):c.410A>G (p.Glu137Gly) | 61748392 | MECP2 | [ ] | ['CAACYCCACTTTAGAGCGAAAGG'] | ['Mental retardation, X-linked, syndromic 13'] |
| NM_020366.3 (RPGRIP1):c.3749-2A>G | 376517859 | RPGRIP1 | [ ] | [ ] | ['Cone-rod dystrophy 13'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000552.3 (VWF):c.2384A>G (p.Tyr795Cys) | 61748478 | VWF | ['GTCAYAG TTCTGGCA CGTTTTGG'] | ['GTCAYAGTTCTG GCACGTTTTGG'] | ['von Willebrand disease type 2N', 'not provided'] |
| NM_001040613.2 (TMEM70):c.*7-2A>G | 183973249 | TMEM70 | [ ] | [ ] | ['Nuclearly-encoded mitochondrial complex V (ATP synthase) deficiency 2'] |
| NM_001005741.2 (GBA):c.1049A>G (p.His350Arg) | 78198234 | GBA | [ ] | [ ] | ['Gaucher disease, perinatal lethal'] |
| NM_000218.2 (KCNQ1):c.332A>G (p.Tyr111Cys) | 199472678 | KCNQ1 | [ ] | [ ] | ['Congenital long QT syndrome', 'Cardiac arrhythmia', 'Long QT syndrome, LQT1 subtype'] |
| NM_000218.2 (KCNQ1):c.344A>G (p.Glu115Gly) | 199472679 | KCNQ1 | | | ['Congenital long QT syndrome', 'Long QT syndrome, LQT1 subtype'] |
| NM_000218.2 (KCNQ1):c.440A>G (p.Gln147Arg) | 199472689 | KCNQ1 | | | ['Atrial fibrillation'] |
| NM_000218.2 (KCNQ1):c.592A>G (p.Ile198Val) | 199472700 | KCNQ1 | [ ] | [ ] | ['Congenital long QT syndrome'] |
| NM_001943.3 (DSG2):c.880A>G (p.Lys294Glu) | 752432726 | DSG2 | [ ] | [ ] | ['Cardiomyopathy'] |
| NM_000218.2 (KCNQ1):c.820A>G (p.Ile274Val) | 199472728 | KCNQ1 | [ ] | [ ] | ['Sudden infant death syndrome', 'Congenital long QT syndrome', 'Cardiac arrhythmia'] |
| NM_000218.2 (KCNQ1):c.842A>G (p.Tyr281Cys) | 199472732 | KCNQ1 | | | ['Congenital long QT syndrome'] |
| NM_000218.2 (KCNQ1):c.950A>G (p.Asp317Gly) | 199472750 | KCNQ1 | | | ['Congenital long QT syndrome'] |
| NM_000218.2 (KCNQ1):c.964A>G (p.Thr322Ala) | 199472754 | KCNQ1 | | | ['Congenital long QT syndrome', 'Cardiac arrhythmia', 'Long QT syndrome, LQT1 subtype'] |
| NM_000218.2 (KCNQ1):c.1138A>G (p.Arg380Gly) | 199472770 | KCNQ1 | | | ['Congenital long QT syndrome'] |
| NM_000218.2 (KCNQ1):c.1193A>G (p.Lys398Arg) | 199472777 | KCNQ1 | | | ['Congenital long QT syndrome', 'Cardiac arrhythmia'] |
| NM_000218.2 (KCNQ1):c.1640A>G (p.Gln547Arg) | 199472798 | KCNQ1 | | | ['Congenital long QT syndrome'] |
| NM_000218.2 (KCNQ1):c.1669A>G (p.Lys557Glu) | 199472801 | KCNQ1 | | | ['Congenital long QT syndrome'] |
| NM_000218.2 (KCNQ1):c.1705A>G (p.Lys569Glu) | 199472808 | KCNQ1 | | | ['Congenital long QT syndrome'] |
| NM_001005741.2 (GBA):c.667T>C (p.Trp223Arg) | 61748906 | GBA | [ ] | ['CCACTYGGCTC AAGACCAATGG'] | ['Gaucher disease, type 1', 'not provided'] |
| NM_000218.2 (KCNQ1):c.1756A>G (p.Asn586Asp) | 199472812 | KCNQ1 | | | ['Congenital long QT syndrome', 'Long QT syndrome, LQT1 subtype'] |
| NM_000218.2 (KCNQ1):c.1793A>G (p.Lys598Arg) | 199472817 | KCNQ1 | | | ['Sudden infant death syndrome'] |

TABLE 8-continued

Human gene mutations that may be corrected by changing a guanine (G) to an
adenine (A). The gene name, gene symbol, and dbSNP database reference number (RS#) are
indicated. Also indicated are exemplary protospacers with their PAM sequences (gRNAs and
gRNAall) and the base to be edited e.g., a C, indicated by a "Y". The "gRNAs" sequences,
from top to bottom, correspond to SEQ ID NOs: 3334-3501. The "gRNA all" sequences,
from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000238.3 (KCNH2):c.82A>G (p.Lys28Glu) | 199472829 | KCNH2 | | | ['Congenital long QT syndrome'] |
| NM_000238.3 (KCNH2):c.128A>G (p.Tyr43Cys) | 199472836 | KCNH2 | | | ['Congenital long QT syndrome', 'Cardiac arrhythmia'] |
| NM_000238.3 (KCNH2):c.301A>G (p.Lys101Glu) | 199472856 | KCNH2 | [ ] | [ ] | ['Congenital long QT syndrome', 'Cardiac arrhythmia'] |
| NM_000238.3 (KCNH2):c.652A>G (p.Met218Val) | 199472869 | KCNH2 | | | ['Congenital long QT syndrome'] |
| NM_000238.3 (KCNH2):c.1424A>G (p.Tyr475Cys) | 199472907 | KCNH2 | | | ['Congenital long QT syndrome'] |
| NM_000238.3 (KCNH2):c.1777A>G (p.Ile593Val) | 199472930 | KCNH2 | | | ['Congenital long QT syndrome'] |
| NM_000238.3 (KCNH2):c.1783A>G (p.Lys595Glu) | 199472932 | KCNH2 | | | ['Congenital long QT syndrome'] |
| NM_000238.3 (KCNH2):c.1790A>G (p.Tyr597Cys) | 199472934 | KCNH2 | | | ['Long QT syndrome', 'Congenital long QT syndrome'] |
| NM_000238.3 (KCNH2):c.1826A>G (p.Asp609Gly) | 199472940 | KCNH2 | | | ['Congenital long QT syndrome'] |
| NM_000238.3 (KCNH2):c.1847A>G (p.Tyr616Cys) | 199472946 | KCNH2 | | | ['Long QT syndrome', 'Congenital long QT syndrome', 'Cardiac arrhythmia'] |
| NM_000238.3 (KCNH2):c.1885A>G (p.Asn629Asp) | 199472956 | KCNH2 | | | ['Congenital long QT syndrome', 'Cardiac arrhythmia'] |
| NM_000238.3 (KCNH2):c.1897A>G (p.Asn633Asp) | 199472960 | KCNH2 | | | ['Congenital long QT syndrome'] |
| NM_000238.3 (KCNH2):c.1903A>G (p.Asn635Asp) | 199472963 | KCNH2 | | | ['Congenital long QT syndrome'] |
| NM_000238.3 (KCNH2):c.1910A>G (p.Glu637Gly) | 199472967 | KCNH2 | | | ['Congenital long QT syndrome'] |
| NM_000238.3 (KCNH2):c.2510A>G (p.Asp837Gly) | 199473004 | KCNH2 | | | ['Congenital long QT syndrome', 'Cardiac arrhythmia'] |
| NM_000238.3 (KCNH2):c.2591A>G (p.Asp864Gly) | 199473008 | KCNH2 | | | ['Congenital long QT syndrome'] |
| NM_000238.3 (KCNH2):c.3118A>G (p.Ser1040Gly) | 199473024 | KCNH2 | [ ] | ['CTGCYCTCCACG TCGCCCCGGGG', 'CCTGCYCTCCAC GTCGCCCCGGG', 'GCCTGCYCTCCA CGTCGCCCCGG'] | ['Sudden infant death syndrome'] |
| NM_000238.3 (KCNH2):c.3233A>G (p.Tyr1078Cys) | 199473029 | KCNH2 | | | ['Congenital long QT syndrome'] |
| NM_000335.4 (SCN5A):c.343A>G (p.Ser115Gly) | 199473057 | SCN5A | | | ['Congenital long QT syndrome'] |
| m.827A>G | 28358569 | MT-RNR1 | [ ] | [ ] | ['Aminoglycoside-induced deafness', 'Deafness, nonsyndromic sensorineural, mitochondrial'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000335.4 (SCN5A):c.688A>G (p.Ile230Val) | 199473074 | SCN5A | ['ATAYAGT TTTCAGGG CCCGGAGG', 'CTGATAY AGTTTTCA GGGCCCGG'] | ['ATAYAGTTTTCA GGGCCCGGAGG', 'CTGATAYAGTTT TCAGGGCCCGG'] | ['Brugada syndrome'] |
| NM_000335.4 (SCN5A):c.715A>G (p.Ile239Val) | 199473075 | SCN5A | | | ['Congenital long QT syndrome'] |
| NM_000252.2 (MTM1):c.575A>G (p.Tyr192Cys) | 587783838 | MTM1 | [ ] | [ ] | ['Severe X-linked myotubular myopathy'] |
| NM_004572.3 (PKP2):c.275T>A (p.Leu92Ter) | 763639737 | PKP2 | [ ] | [ ] | ['not provided'] |
| NM_000335.4 (SCN5A):c.1502A>G (p.Asp501Gly) | 199473117 | SCN5A | | | ['Brugada syndrome'] |
| NM_000335.4 (SCN5A):c.2249A>G (p.Gln750Arg) | 199473152 | SCN5A | | | ['Congenital long QT syndrome'] |
| NM_198056.2 (SCN5A):c.2527A>G (p.Thr843Ala) | 199473165 | SCN5A | | | ['Congenital long QT syndrome', 'not provided'] |
| NM_001165963.1 (SCN1A):c.1277A>G (p.Tyr426Cys) | 796052973 | SCN1A | [ ] | [ ] | ['not provided'] |
| NM_000335.4 (SCN5A):c.3755A>G (p.Glu1252Gly) | 199473214 | SCN5A | | | ['Brugada syndrome'] |
| NM_198056.2 (SCN5A):c.4000A>G (p.Ile1334Val) | 199473226 | SCN5A | [ ] | [ ] | ['Congenital long QT syndrome', 'not provided'] |
| NM_000335.4 (SCN5A):c.4252A>G (p.Lys1418Glu) | 199473242 | SCN5A | | | ['Brugada syndrome'] |
| NM_000335.4 (SCN5A):c.4291A>G (p.Arg1431Gly) | 199473245 | SCN5A | | | ['Brugada syndrome'] |
| NM_000335.4 (SCN5A):c.4412A>G (p.Asn1471Ser) | 199473255 | SCN5A | | | ['Congenital long QT syndrome'] |
| NM_198056.2 (SCN5A):c.4478A>G (p.Lys1493Arg) | 199473260 | SCN5A | [ ] | [ ] | ['Atrial fibrillation', 'Congenital long QT syndrome', 'not provided'] |
| NM_000335.4 (SCN5A):c.4489A>G (p.Met1497Val) | 199473264 | SCN5A | | | ['Congenital long QT syndrome'] |
| NM_000335.4 (SCN5A):c.4577A>G (p.Lys1526Arg) | 199473270 | SCN5A | | | ['Brugada syndrome'] |
| NM_000335.4 (SCN5A):c.5161A>G (p.Asn1721Asp) | 199473299 | SCN5A | | | ['Brugada syndrome'] |
| NM_198056.2 (SCN5A):c.5302A>G (p.Ile1768Val) | 199473311 | SCN5A | | | ['Congenital long QT syndrome', 'not provided'] |
| NM_000335.4 (SCN5A):c.5318A>G (p.Asn1773Ser) | 199473313 | SCN5A | | | ['Brugada syndrome'] |
| NM_000335.4 (SCN5A):c.5366A>G (p.Asp1789Gly) | 199473317 | SCN5A | | | ['Congenital long QT syndrome'] |
| NM_000335.4 (SCN5A):c.5402A>G (p.Asp1801Gly) | 199473318 | SCN5A | | | ['Congenital long QT syndrome'] |
| NM_000335.4 (SCN5A):c.5513A>G (p.Asp1838Gly) | 199473321 | SCN5A | | | ['Congenital long QT syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_198056.2 (SCN5A):c.5726A>G (p.Gln1909Arg) | 199473326 | SCN5A | | | ['Congenital long QT syndrome', 'not provided'] |
| NM_172201.1 (KCNE2):c.269A>G (p.Glu90Gly) | 199473366 | KCNE2 | | | ['Atrial fibrillation'] |
| NM_000891.2 (KCNJ2):c.223A>G (p.Thr75Ala) | 199473370 | KCNJ2 | | | ['Congenital long QT syndrome'] |
| NM_000891.2 (KCNJ2):c.233A>G (p.Asp78Gly) | 199473371 | KCNJ2 | | | ['Andersen Tawil syndrome', 'Congenital long QT syndrome'] |
| NM_000891.2 (KCNJ2):c.574A>G (p.Thr192Ala) | 199473382 | KCNJ2 | | | ['Congenital long QT syndrome'] |
| NM_000218.2 (KCNQ1):c.548A>G (p.Lys183Arg) | 199473396 | KCNQ1 | | | ['Congenital long QT syndrome'] |
| NM_000218.2 (KCNQ1):c.1061A>G (p.Lys354Arg) | 199473404 | KCNQ1 | | | ['Congenital long QT syndrome'] |
| NM_000218.2 (KCNQ1):c.1070A>G (p.Gln357Arg) | 199473405 | KCNQ1 | | | ['Congenital long QT syndrome', 'Cardiac arrhythmia', 'Long QT syndrome, LQT1 subtype'] |
| NM_000218.2 (KCNQ1):c.1078A>G (p.Arg360Gly) | 199473406 | KCNQ1 | [ ] | [ ] | ['Congenital long QT syndrome'] |
| NM_000238.3 (KCNH2):c.209A>G (p.His70Arg) | 199473419 | KCNH2 | | | ['Congenital long QT syndrome', 'Cardiac arrhythmia'] |
| NM_000238.3 (KCNH2):c.1724A>G (p.Glu575Gly) | 199473424 | KCNH2 | | | ['Congenital long QT syndrome'] |
| NM_000238.3 (KCNH2):c.1747A>G (p.Ile583Val) | 199473427 | KCNH2 | | | ['Congenital long QT syndrome'] |
| NM_000238.3 (KCNH2):c.1762A>G (p.Asn588Asp) | 199473431 | KCNH2 | | | ['Congenital long QT syndrome'] |
| NM_000218.2 (KCNQ1):c.430A>G (p.Thr144Ala) | 199473451 | KCNQ1 | | | ['Congenital long QT syndrome'] |
| NM_000218.2 (KCNQ1):c.931A>G (p.Thr311Ala) | 199473469 | KCNQ1 | | | ['Congenital long QT syndrome'] |
| NM_000238.3 (KCNH2):c.286A>G (p.Ile96Val) | 199473496 | KCNH2 | | | ['Congenital long QT syndrome'] |
| NM_000238.3 (KCNH2):c.1205A>G (p.His402Arg) | 199473506 | KCNH2 | | | ['Congenital long QT syndrome'] |
| NM_000238.3 (KCNH2):c.1259A>G (p.Tyr420Cys) | 199473507 | KCNH2 | | | ['Congenital long QT syndrome'] |
| NM_000238.3 (KCNH2):c.1502A>G (p.Asp501Gly) | 199473513 | KCNH2 | | | ['Congenital long QT syndrome', 'Cardiac arrhythmia'] |
| NM_000238.3 (KCNH2):c.1912A>G (p.Lys638Glu) | 199473528 | KCNH2 | | | ['Congenital long QT syndrome'] |
| NM_000238.3 (KCNH2):c.2131A>G (p.Ile711Val) | 199473532 | KCNH2 | [ ] | [ ] | ['Long QT syndrome', 'Congenital long QT syndrome', 'Cardiac arrhythmia'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000238.3 (KCNH2):c.2266A>G (p.Met756Val) | 199473534 | KCNH2 | | | ['Acquired long QT syndrome'] |
| NM_000238.3 (KCNH2):c.3343A>G (p.Met1115Val) | 199473546 | KCNH2 | | | ['Congenital long QT syndrome', 'Cardiac arrhythmia'] |
| NM_000335.4 (SCN5A):c.89A>G (p.Glu30Gly) | 199473551 | SCN5A | | | ['Congenital long QT syndrome'] |
| NM_000335.4 (SCN5A):c.1217A>G (p.Asn406Ser) | 199473568 | SCN5A | | | ['Brugada syndrome'] |
| NM_000249.3 (MLH1):c.791-2A>G | 267607794 | MLH1 | [ ] | [ ] | ['Hereditary Nonpolyposis Colorectal Neoplasms', 'Hereditary cancer-predisposing syndrome'] |
| NM_000335.4 (SCN5A):c.2780A>G (p.Asn927Ser) | 199473589 | SCN5A | | | ['Brugada syndrome'] |
| NM_000335.4 (SCN5A):c.3164A>G (p.Asp1055Gly) | 199473593 | SCN5A | | | ['Brugada syndrome'] |
| NM_000335.4 (SCN5A):c.4223A>G (p.Tyr1408Cys) | 199473610 | SCN5A | | | ['Brugada syndrome'] |
| NM_198056.2 (SCN5A):c.4346A>G (p.Tyr1449Cys) | 199473613 | SCN5A | | | ['Brugada syndrome', 'not provided'] |
| NM_198056.2 (SCN5A):c.4978A>G (p.Ile1660Val) | 199473625 | SCN5A | ['CGAYGTT GAAGAGG GCAGGCAG G'] | ['CGAYGTTGAAG AGGGCAGGCAGG', 'AGCCCGAYGTTG AAGAGGGCAGG'] | ['Brugada syndrome', 'not provided'] |
| NM_000335.4 (SCN5A):c.5138A>G (p.Asp1713Gly) | 199473628 | SCN5A | | | ['Brugada syndrome'] |
| NM_000335.4 (SCN5A):c.5297A>G (p.Tyr1766Cys) | 199473632 | SCN5A | | | ['Congenital long QT syndrome'] |
| NM_000335.4 (SCN5A):c.5317A>G (p.Asn1773Asp) | 199473633 | SCN5A | | | ['Congenital long QT syndrome'] |
| NM_000531.5 (OTC):c.527A>G (p.Tyr176Cys) | 72556283 | OTC | ['TGAGGYA ATCAGCCA GGATCTGG'] | ['TGAGGYAATCA GCCAGGATCTGG'] | ['not provided'] |
| NM_001130823.1 (DNMT1):c.1532A>G (p.Tyr511Cys) | 199473690 | DNMT1 | | | ['Hereditary sensory neuropathy type IE'] |
| NM_000303.2 (PMM2):c.563A>G (p.Asp188Gly) | 80338704 | PMM2 | [ ] | [ ] | ['Carbohydrate-deficient glycoprotein syndrome type I', 'not provided'] |
| NM_000051.3 (ATM):c.8030A>G (p.Tyr2677Cys) | 28942103 | — | [ ] | [ ] | ['Ataxia-telangiectasia variant'] |
| NM_175053.3 (KRT74):c.821T>C (p.Phe274Ser) | 147962513 | KRT74 | [ ] | [ ] | ['"Ectodermal dysplasia, 'pure' hair-nail type"', 'Ectodermal dysplasia 7, hair/nail type'] |
| NM_000059.3 (BRCA2):c.426-2A>G | 398122779 | BRCA2 | [ ] | [ ] | ['Familial cancer of breast', 'Breast-ovarian cancer, familial 2'] |
| NM_133433.3 (NIPBL):c.5428-2A>G | 587783974 | NIPBL | [ ] | [ ] | ['Cornelia de Lange syndrome 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000238.3 (KCNH2):c.1129-2A>G | 794728365 | KCNH2 | [ ] | ['GGACCYGCACC CGGGGAAGGCGG'] | ['Cardiac arrhythmia'] |
| NM_000260.3 (MYO7A):c.6029A>G (p.Asp2010Gly) | 111033175 | MYO7A | [ ] | [ ] | ['Usher syndrome, type 1'] |
| NM_000531.5 (OTC):c.548A>G (p.Tyr183Cys) | 72556293 | OTC | [ ] | ['AGAGCTAYAGT GTTCCTAAAAGG'] | ['not provided'] |
| NM_000441.1 (SLC26A4):c.1151A>G (p.Glu384Gly) | 111033244 | SLC26A4 | [ ] | ['TGAATYCCTAAG GAAGAGACTGG'] | ['Pendred syndrome', 'Enlarged vestibular aqueduct syndrome'] |
| NM_004004.5 (GJB2):c.617A>G (p.Asn206Ser) | 111033294 | GJB2 | [ ] | [ ] | ['Deafness, autosomal recessive 1A', 'Hearing impairment'] |
| NM_000441.1 (SLC26A4):c.919-2A>G | 111033313 | SLC26A4 | [ ] | [ ] | ['Pendred syndrome', 'Enlarged vestibular aqueduct syndrome'] |
| NM_001363.4 (DKC1):c.115A>G (p.Lys39Glu) | 121912296 | DKC1 | [ ] | [ ] | ['Dyskeratosis congenita X-linked'] |
| NM_001363.4 (DKC1):c.196A>G (p.Thr66Ala) | 121912297 | DKC1 | [ ] | [ ] | ['Dyskeratosis congenita X-linked'] |
| NM_001363.4 (DKC1):c.361A>G (p.Ser121Gly) | 121912305 | DKC1 | [ ] | [ ] | ['Dyskeratosis congenita X-linked', 'Hoyeraal Hreidarsson syndrome'] |
| NM_178151.2 (DCX):c.413A>G (p.Tyr138Cys) | 587783552 | DCX | [ ] | [ ] | ['Heterotopia'] |
| NM_024675.3 (PALB2):c.212-2A>G | 730881879 | PALB2 | [ ] | [ ] | ['Hereditary cancer-predisposing syndrome'] |
| NM_000260.3 (MYO7A):c.1344-2A>G | 111033415 | MYO7A | [ ] | ['AGCYGCAGGGG CACAGGGATGGG', 'AAGCYGCAGGGG CACAGGGATGG'] | ['Usher syndrome, type 1'] |
| NM_000454.4 (SOD1):c.131A>G (p.His44Arg) | 121912435 | SOD1 | [ ] | [ ] | ['Amyotrophic lateral sclerosis type 1'] |
| NM_000454.4 (SOD1):c.302A>G (p.Glu101Gly) | 121912439 | SOD1 | [ ] | ['AGAATCTYCAAT AGACACATCGG'] | ['Amyotrophic lateral sclerosis type 1'] |
| NM_000454.4 (SOD1):c.140A>G (p.His47Arg) | 121912443 | SOD1 | [ ] | [ ] | ['Amyotrophic lateral sclerosis type 1'] |
| NM_133433.3 (NIPBL):c.737A>G (p.Asp246Gly) | 587784042 | NIPBL | [ ] | [ ] | ['Cornelia de Lange syndrome 1'] |
| NM_000454.4(SOD1): c.242A>G (p.His81Arg) | 121912458 | SOD1 | [ ] | [ ] | ['Amyotrophic lateral sclerosis type 1'] |
| NM_001754.4 (RUNX1):c.328A>G (p.Lys110Glu) | 121912498 | RUNX1 | [ ] | [ ] | ['Familial platelet disorder with associated myeloid malignancy'] |
| NM_000238.3 (KCNH2):c.1408A>G (p.Asn470Asp) | 121912505 | KCNH2 | [ ] | [ ] | ['Long QT syndrome 2', 'Congenital long QT syndrome'] |
| NM_000233.3 (LHCGR):c.1733A>G (p.Asp578Gly) | 121912518 | — | [ ] | [ ] | ['Gonadotropin-independent familial sexual precocity'] |
| NM_000493.3 (COL10A1):c.1790A>G (p.Tyr597Cys) | 111033554 | — | [ ] | [ ] | ['Metaphyseal chondrodysplasia, Schmid type'] |
| NM_000233.3 (LHCGR):c.1691A>G (p.Asp564Gly) | 121912540 | — | [ ] | [ ] | ['Gonadotropin-independent familial sexual precocity'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_002769.4 (PRSS1):c.68A>G (p.Lys23Arg) | 111033567 | — | [ ] | ['ATCYTGTCATCA TCATCAAAGGG', 'GATCYTGTCATC ATCATCAAAGG'] | ['Hereditary pancreatitis'] |
| NM_004999.3 (MYO6):c.737A>G (p.His246Arg) | 121912560 | MYO6 | [ ] | [ ] | ['Sensorineural deafness with hypertrophic cardiomyopathy'] |
| NM_000901.4 (NR3C2):c.2327A>G (p.Gln776Arg) | 121912565 | NR3C2 | [ ] | ['TCATCYGTTTGC CTGCTAAGCGG'] | ['Pseudohypoaldosteronism type 1 autosomal dominant'] |
| NM_000901.4 (NR3C2):c.2915A>G (p.Glu972Gly) | 121912574 | NR3C2 | [ ] | ['CCGACYCCACCT TGGGCAGCTGG'] | ['Pseudohypo- aldosteronism type 1 autosomal dominant'] |
| NM_001173464.1 (KIF21A):c.2839A>G (p.Met947Val) | 121912589 | KIF21A | [ ] | ['ATTCAYATCTGC CTCCATGTTGG'] | ['Fibrosis of extraocular muscles, congenital, 1'] |
| NM_000155.3 (GALT):c.67A>G (p.Thr23Ala) | 111033635 | GALT | [ ] | [ ] | ['Deficiency of UDPglucose- hexose-1-phosphate uridylyltransferase'] |
| NM_001041.3 (SI):c.350A>G (p.Gln117Arg) | 121912612 | SI | [ ] | [ ] | ['Sucrase-isomaltase deficiency'] |
| NM_000155.3 (GALT):c.1A>G (p.Met1Val) | 111033639 | GALT | [ ] | [ ] | ['Deficiency of UDPglucose- hexose-1-phosphate uridylyltransferase'] |
| NM_021625.4 (TRPV4):c.998A>G (p.Asp333Gly) | 121912634 | TRPV4 | [ ] | [ ] | ['Spondylometaphyseal dysplasia, Kozlowski type'] |
| NM_000155.3 (GALT):c.253-2A>G | 111033661 | GALT | [ ] | ['ATTCACCYACCG ACAAGGATAGG'] | ['Deficiency of UDPglucose- hexose-1-phosphate uridylyltransferase', 'not provided'] |
| NM_000155.3 (GALT):c.290A>G (p.Asn97Ser) | 111033669 | GALT | [ ] | ['GAAGTCGYTGTC AAACAGGAAGG'] | ['Deficiency of UDPglucose- hexose-1-phosphate uridylyltransferase'] |
| NM_000155.3 (GALT):c.379A>G (p.Lys127Glu) | 111033682 | GALT | [ ] | ['TGACCTYACTGG GTGGTGACGGG', 'ATGACCTYACTG GGTGGTGACGG'] | ['Deficiency of UDPglucose- hexose-1-phosphate uridylyltransferase'] |
| NM_000343.3 (SLC5A1):c.83A>G (p.Asp28Gly) | 121912669 | SLC5A1 | [ ] | [ ] | ['Congenital glucose-galactose malabsorption'] |
| NM_005159.4 (ACTC1):c.1088A>G (p.Glu363Gly) | 121912674 | — | [ ] | [ ] | ['Dilated cardiomyopathy 1R'] |
| NM_005159.4 (ACTC1):c.373A>G (p.Met125Val) | 121912677 | — | [ ] | [ ] | ['Atrial septal defect 5'] |
| NM_000155.3 (GALT):c.565-2A>G | 111033731 | GALT | [ ] | [ ] | ['Deficiency of UDPglucose- hexose-1-phosphate uridylyltransferase'] |
| NM_001681.3 (ATP2A2):c.2300A>G (p.Asn767Ser) | 121912732 | ATP2A2 | [ ] | [ ] | ['Darier disease, acral hemorrhagic type'] |
| NM_000155.3 (GALT):c.821-2A>G | 111033767 | GALT | [ ] | [ ] | ['Deficiency of UDPglucose- hexose-1-phosphate uridylyltransferase'] |
| NM_000342.3 (SLC4A1):c.2509A>G (p.Thr837Ala) | 121912750 | SLC4A1 | [ ] | [ ] | ['Spherocytosis type 4'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000155.3 (GALT):c.950A>G (p.Gln317Arg) | 111033786 | GALT | [ ] | ['CAGCYGCCAAT GGTTCCAGTTGG'] | ['Deficiency of UDPglucose-hexose-1-phosphate uridylyltransferase'] |
| NM_001202.3 (BMP4):c.278A>G (p.Glu93Gly) | 121912765 | BMP4 | [ ] | ['CCTCCYCCCCAG ACTGAAGCCGG'] | ['Microphthalmia syndromic 6'] |
| NM_000155.3 (GALT):c.1001A>G (p.Lys334Arg) | 111033809 | GALT | [ ] | [ ] | ['Deficiency of UDPglucose-hexose-1-phosphate uridylyltransferase'] |
| NM_000155.3 (GALT):c.1048A>G (p.Thr350Ala) | 111033817 | GALT | [ ] | [ ] | ['Deficiency of UDPglucose-hexose-1-phosphate uridylyltransferase'] |
| NM_000155.3 (GALT):c.1132A>G (p.Ile378Val) | 111033819 | GALT | [ ] | [ ] | ['Deficiency of UDPglucose-hexose-1-phosphate uridylyltransferase'] |
| m.3243A>G | 199474657 | MT-TL1 | [ ] | [ ] | ['Leigh disease', 'Cyclical vomiting syndrome', 'Juvenile myopathy, encephalopathy, lactic acidosis AND stroke', 'Myoclonus with epilepsy with ragged red fibers', 'Cytochrome-c oxidase deficiency', 'Diabetes-deafness syndrome maternally transmitted', '3-Methylglutaconic aciduria', 'Age-related macular degeneration 2', 'MERRF/MELAS overlap syndrome'] |
| m.3252A>G | 199474661 | MT-TL1 | [ ] | [ ] | ['Mitochondrial encephalomyopathy'] |
| m.3251A>G | 199474662 | MT-TL1 | [ ] | [ ] | [ ] |
| NM_000258.2 (MYL3):c.517A>G (p.Met173Val) | 199474708 | MYL3 | [ ] | [ ] | ['Cardiomyopathy', 'not specified', 'not provided'] |
| NM_000094.3 (COL7A1):c.425A>G (p.Lys142Arg) | 121912856 | COL7A1 | [ ] | ['CACCYTGGGGA CACCAGGTCGGG', 'TCACCYTGGGGA CACCAGGTCGG'] | ['Epidermolysis bullosa dystrophica inversa, autosomal recessive'] |
| NM_152263.3 (TPM3):c.505A>G (p.Lys169Glu) | 199474715 | TPM3 | [ ] | ['CCAACTYACGA GCCACCTACAGG'] | ['Congenital myopathy with fiber type disproportion', 'not provided'] |
| NM_152263.3 (TPM3):c.733A>G (p.Arg245Gly) | 199474718 | TPM3 | [ ] | ['ATCYCTCAGCAA ACTCAGCACGG'] | ['Congenital myopathy with fiber type disproportion', 'not provided'] |
| NM_001844.4 (COL2A1):c.4172A>G (p.Tyr1391Cys) | 121912889 | COL2A1 | ['GCAGTGG YAGGTGAT GTTCTGGG'] | ['GCAGTGGYAGG TGATGTTCTGGG'] | ['Spondyloperipheral dysplasia', 'Platyspondylic lethal skeletal dysplasia Torrance type'] |
| NM_001844.4 (COL2A1):c.2974A>G (p.Arg992Gly) | 121912895 | COL2A1 | [ ] | ['CCTCYCTCACCA CGTTGCCCAGG'] | ['Spondyloepimeta-physeal dysplasia Strudwick type'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001848.2 (COL6A1):c.362A>G (p.Lys121Arg) | 121912936 | COL6A1 | [ ] | [ ] | ['Ullrich congenital muscular dystrophy', 'Bethlem myopathy', 'not provided'] |
| NM_004004.5 (GJB2):c.218A>G (p.His73Arg) | 121912968 | GJB2 | [ ] | [ ] | ['Keratoderma palmoplantar deafness'] |
| NM_000941.2 (POR):c.1733A>G (p.Tyr578Cys) | 121912975 | POR | [ ] | [ ] | ['Antley-Bixler syndrome with genital anomalies and disordered steroidogenesis'] |
| NM_001943.3 (DSG2):c.797A>G (p.Asn266Ser) | 121913011 | DSG2 | [ ] | [ ] | ['Arrhythmogenic right ventricular cardiomyopathy, type 10'] |
| NM_000129.3 (F13A1):c.851A>G (p.Tyr284Cys) | 121913074 | F13A1 | [ ] | ['ATAGGCAYAGA TATTGTCCCAGG'] | ['Factor xiii, a subunit, deficiency of'] |
| NM_000043.4 (FAS):c.695A>G (p.Tyr232Cys) | 121913079 | FAS | [ ] | [ ] | ['Autoimmune lymphoproliferative syndrome, type 1a'] |
| NM_000043.4 (FAS):c.763A>G (p.Asn255Asp) | 121913082 | FAS | [ ] | [ ] | [ ] |
| NM_000043.4 (FAS):c.353A>G (p.Asn118Ser) | 121913083 | FAS | [ ] | [ ] | [ ] |
| NM_206933.2 (USH2A):c.14020A>G (p.Arg4674Gly) | 80338904 | USH2A | [ ] | [ ] | ['Retinitis pigmentosa', 'Retinitis pigmentosa 39'] |
| NM_000142.4 (FGFR3):c.833A>G (p.Tyr278Cys) | 121913115 | FGFR3 | [ ] | [ ] | ['Hypochondroplasia'] |
| NM_000183.2 (HADHB):c.788A>G (p.Asp263Gly) | 121913131 | HADHB | [ ] | [ ] | ['Mitochondrial trifunctional protein deficiency'] |
| NM_001079817.1 (INSR):c.1459A>G (p.Lys487Glu) | 121913136 | INSR | [ ] | [ ] | ['Leprechaunism syndrome'] |
| NM_000208.2 (INSR):c.707A>G (p.His236Arg) | 121913145 | INSR | [ ] | ['GCTGYGGCAAC AGAGGCCTTCGG'] | ['Leprechaunism syndrome'] |
| NM_000208.2 (INSR):c.1466A>G (p.Asn489Ser) | 121913147 | INSR | [ ] | [ ] | ['Insulin-resistant diabetes mellitus AND acanthosis nigricans'] |
| NM_000208.2 (INSR):c.1372A>G (p.Asn458Asp) | 121913160 | INSR | [ ] | [ ] | ['Leprechaunism syndrome'] |
| NM_000016.5 (ACADM):c.797A>G (p.Asp266Gly) | 201375579 | ACADM | [ ] | [ ] | ['not provided'] |
| NM_024577.3 (SH3TC2):c.530-2A>G | 80338920 | SH3TC2 | [ ] | [ ] | ['Charcot-Marie-Tooth disease, type 4C'] |
| NM_001127500.1 (MET):c.3743A>G (p.Tyr1248Cys) | 121913246 | MET | [ ] | [ ] | ['Renal cell carcinoma, papillary, 1'] |
| NM_000517.4 (HBA2):c.*92A>G | 63750067 | HBA2 | ['ACTTYAT TCAAAGAC CAGGAAG G'] | ['CTTYATTCAAAG ACCAGGAAGGG', 'ACTTYATTCAAA GACCAGGAAGG'] | ['Hemoglobin H disease, nondeletional'] |
| NM_199440.1 (HSPD1):c.86A>G (p.Asp29Gly) | 72466451 | HSPD1 | [ ] | [ ] | ['Leukodystrophy, hypomyelinating, 4'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000249.3 (MLH1):c.544A>G (p.Arg182Gly) | 63750211 | MLH1 | [ ] | [ ] | ['Hereditary Nonpolyposis Colorectal Neoplasms'] |
| NM_025137.3 (SPG11):c.1457-2A>G | 312262726 | SPG11 | [ ] | [ ] | ['Spastic paraplegia 11, autosomal recessive'] |
| NM_025137.3 (SPG11):c.2608A>G (p.Ile870Val) | 312262745 | SPG11 | [ ] | ['ACTTAYCCTGGG GAGAAGGATGG'] | ['Spastic paraplegia 11, autosomal recessive'] |
| NM_025137.3 (SPG11):c.2833A>G (p.Arg945Gly) | 312262748 | SPG11 | [ ] | [ ] | ['Spastic paraplegia 11, autosomal recessive'] |
| NM_003867.3 (FGF17):c.560A>G (p.Asn187Ser) | 398123026 | FGF17 | ['CGTGGYT GGGAAG GGCAGCTG G'] | ['CGTGGYTGGGG AAGGGCAGCTGG'] | ['Hypogonadotropic hypogonadism 20 with or without anosmia'] |
| NM_025137.3 (SPG11):c.6477+4A>G | 312262780 | SPG11 | [ ] | [ ] | ['Spastic paraplegia 11, autosomal recessive'] |
| NM_000141.4 (FGFR2):c.1124A>G (p.Tyr375Cys) | 121913478 | FGFR2 | [ ] | [ ] | ['Cutis Gyrata syndrome of Beare and Stevenson', 'Endometrial carcinoma'] |
| NM_000142.4 (FGFR3):c.1118A>G (p.Tyr373Cys) | 121913485 | FGFR3 | [ ] | [ ] | ['Thanatophoric dysplasia type 1'] |
| NM_003611.2 (OFD1):c.290A>G (p.Glu97Gly) | 312262820 | OFD1 | [ ] | [ ] | ['Oral-facial-digital syndrome'] |
| NM_000222.2 (KIT):c.1924A>G (p.Lys642Glu) | 121913512 | KIT | ['GACTTYG AGTTCAGA CATGAGGG'] | ['GACTTYGAGTTC AGACATGAGGG', 'GGACTTYGAGTT CAGACATGAGG'] | [ ] |
| NM_003611.2 (OFD1):c.382-2A>G | 312262829 | OFD1 | [ ] | [ ] | ['Oral-facial-digital syndrome'] |
| NM_000391.3 (TPP1):c.857A>G (p.Asn286Ser) | 119455958 | TPP1 | [ ] | [ ] | ['Ceroid lipofuscinosis, neuronal, 2'] |
| NM_005912.2 (MC4R):c.508A>G (p.Ile170Val) | 121913560 | MC4R | [ ] | [ ] | ['Obesity'] |
| NM_005912.2 (MC4R):c.821A>G (p.Asn274Ser) | 121913561 | MC4R | [ ] | [ ] | ['Obesity'] |
| NM_005912.2 (MC4R):c.289A>G (p.Asn97Asp) | 121913565 | MC4R | [ ] | [ ] | ['Obesity'] |
| NM_005912.2 (MC4R):c.185A>G (p.Asn62Ser) | 121913566 | MC4R | [ ] | [ ] | ['Obesity'] |
| NM_000530.6 (MPZ):c.286A>G (p.Lys96Glu) | 121913583 | MPZ | [ ] | [ ] | ['Charcot-Marie-Tooth disease type 1B'] |
| NM_000095.2 (COMP):c.1760A>G (p.His587Arg) | 312262901 | COMP | [ ] | [ ] | ['Pseudoachondroplastic spondyloepiphyseal dysplasia syndrome'] |
| NM_000530.6 (MPZ):c.242A>G (p.His81Arg) | 121913594 | MPZ | ['GGCATAG YGGAAGAT CTATGAGG'] | ['GGCATAGYGGA AGATCTATGAGG'] | ['Charcot-Marie-Tooth disease type 1B'] |
| NM_000484.3 (APP):c.2146A>G (p.Ile716Val) | 63750399 | APP | [ ] | [ ] | ['Alzheimer disease, type 1', 'not provided'] |
| NM_000329.2 (RPE65):c.1292A>G (p.Tyr431Cys) | 62636300 | RPE65 | [ ] | [ ] | ['Leber congenital amaurosis 2', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_002470.3 (MYH3):c.1385A>G (p.Asp462Gly) | 121913622 | MYH3 | [ ] | [ ] | ['Distal arthrogryposis type 2B'] |
| NM_000257.3 (MYH7):c.2333A>G (p.Asp778Gly) | 121913634 | MYH7 | [ ] | [ ] | ['Familial hypertrophic cardiomyopathy 1', 'not specified'] |
| NM_001127500.1 (MET):c.3785A>G (p.Lys1262Arg) | 121913677 | MET | [ ] | [ ] | ['Childhood hepatocellular carcinoma'] |
| NM_000222.2 (KIT):c.2459A>G (p.Asp820Gly) | 121913682 | KIT | [ ] | ['AGAAYCATTCTT GATGTCTCTGG'] | ['Mast cell disease, systemic'] |
| NM_000222.2 (KIT):c.2386A>G (p.Arg796Gly) | 121913684 | KIT | [ ] | [ ] | [ ] |
| NM_006005.3 (WFS1):c.1385A>G (p.Glu462Gly) | 398123066 | WFS1 | [ ] | [ ] | ['Cataract, nuclear total'] |
| NM_000495.4 (COL4A5):c.3925-2A>G | 587776400 | COL4A5 | [ ] | [ ] | ['Alport syndrome, X-linked recessive'] |
| NC_012920.1: m.13514A>G | 587776440 | MT-NDS | [ ] | [ ] | ['Leigh disease'] |
| NM_000021.3 (PSEN1):c.488A>G (p.His163Arg) | 63750590 | PSEN1 | [ ] | [ ] | ['Alzheimer disease, type 3', 'not provided'] |
| NM_000484.3 (APP):c.2140A>G (p.Thr714Ala) | 63750643 | APP | [ ] | [ ] | ['Alzheimer disease, type 1', 'not provided'] |
| NM_173560.3 (RFX6):c.224-12A>G | 587776515 | RFX6 | [ ] | [ ] | ['Mitchell-Riley syndrome'] |
| NM_014043.3 (CHMP2B):c.85A>G (p.Ile29Val) | 63750818 | CHMP2B | [ ] | [ ] | ['Frontotemporal Dementia, Chromosome 3-Linked', 'Amyotrophic lateral sclerosis 17', 'not provided'] |
| NM_000057.3 (BLM):c.1088-2A>G | 367543015 | BLM | [ ] | [ ] | ['Bloom syndrome'] |
| NM_001011658.3 (TRAPPC2):c.238+4T>C | 587776753 | — | [ ] | [ ] | ['Spondyloepiphyseal dysplasia tarda'] |
| NM_000151.3 (G6PC):c.230+4A>G | 587776757 | G6PC | [ ] | ['GTTCYTACCACT TAAAGACAGG'] | ['Glycogen storage disease type 1A'] |
| NM_000463.2 (UGT1A1):c.1085-2A>G | 587776766 | — | ['ACCYGAG ATGCAAAA TAGGGAGG'] | ['ACCYGAGATGC AAAATAGGGAGG', 'GTGACCYGAGAT GCAAAATAGGG', 'GGTGACCYGAGA TGCAAAATAGG'] | ['Crigler Najjar syndrome, type 1'] |
| NM_000330.3 (RS1):c.286T>C (p.Trp96Arg) | 61752063 | — | [ ] | ['TTCTTCGYGGAC TGCAAACAAGG'] | ['Juvenile retinoschisis', 'not provided'] |
| NM_001024847.2 (TGFBR2):c.1472-2A>G | 587776770 | TGFBR2 | [ ] | [ ] | ['Loeys-Dietz syndrome 2'] |
| NM_000257.3 (MYH7):c.5807A>G (p.Ter1936Trp) | 367543053 | MYH7 | [ ] | [ ] | ['Congenital myopathy with fiber type disproportion'] |
| NM_000321.2 (RB1):c.2490-1398A>G | 587776791 | RB1 | [ ] | [ ] | ['Retinoblastoma'] |
| NM_024549.5 (TCTN1):c.221-2A>G | 367543065 | TCTN1 | [ ] | ['AGCAACYGCAG AAAAAAGAGGGG', 'CAGCAACYGCAG AAAAAAGAGGG'] | ['Joubert syndrome 13'] |
| NM_000228.2 (LAMB3):c.565-3T>C | 587776813 | LAMB3 | [ ] | [ ] | ['Adult junctional epidermolysis bullosa'] |
| NM_015884.3 (MBTPS2):c.1523A>G (p.Asn508Ser) | 587776867 | MBTPS2 | [ ] | [ ] | ['Keratosis pilaris decalvans'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000174.4 (GP9):c.182A>G (p.Asn61Ser) | 5030764 | GP9 | ['GGCTGYTGTTGGCCAGCAGAAGG'] | ['GGCTGYTGTTGGCCAGCAGAAGG'] | ['Bernard-Soulier syndrome type C'] |
| NM_000894.2 (LHB):c.221A>G (p.Gln74Arg) | 5030773 | LHB | [ ] | ['CCACCYGAGGCAGGGGCGGCAGG'] | ['Isolated lutropin deficiency'] |
| NM_000264.3 (PTCH1):c.2479A>G (p.Ser827Gly) | 199476092 | — | [ ] | ['CGTTACYGAAACTCCTGTGTAGG'] | ['Gorlin syndrome', 'Holoprosencephaly 7', 'not specified', 'not provided'] |
| NM_000021.3 (PSEN1):c.415A>G (p.Met139Val) | 63751037 | PSEN1 | [ ] | [ ] | ['Alzheimer disease, type 3', 'not provided'] |
| NM_000484.3 (APP):c.2078A>G (p.Glu693Gly) | 63751039 | APP | [ ] | [ ] | ['Alzheimer disease', 'Alzheimer disease, type 1', 'Cerebral amyloid angiopathy, APP-related', 'not provided'] |
| NM_000117.2 (EMD):c.450-2A>G | 398123158 | EMD | [ ] | ['CGTTCCCYGAGGCAAAAGAGGGG'] | ['not provided'] |
| RMRP:n.71A>G | 199476103 | RMRP | [ ] | ['ACTTYCCCCTAGGCGGAAAGGGG', 'GACTTYCCCCTAGGCGGAAAGGG', 'GGACTTYCCCCTAGGCGGAAAGG'] | ['Metaphyseal chondrodysplasia, McKusick type', 'Metaphyseal dysplasia without hypotrichosis'] |
| m.14495A>G | 199476106 | MT-ND6 | [ ] | [ ] | ['Leber optic atrophy'] |
| m.11084A>G | 199476113 | MT-ND4 | [ ] | [ ] | ['Juvenile myopathy, encephalopathy, lactic acidosis AND stroke'] |
| NM_000551.3 (VHL):c.233A>G (p.Asn78Ser) | 5030804 | VHL | ['TGCGAYTGCAGAAGATGACCTGG'] | ['GCGAYTGCAGAAGATGACCTGG', 'TGCGAYTGCAGAAGATGACCTGG'] | ['Von Hippel-Lindau syndrome'] |
| m.3397A>G | 199476120 | MT-ND1 | [ ] | [ ] | ['Alzheimer disease', 'Parkinson disease, late-onset'] |
| m.4136A>G | 199476121 | MT-ND1 | [ ] | [ ] | ['Leber optic atrophy'] |
| NM_003094.3 (SNRPE):c.1A>G (p.Met1Val) | 587776924 | SNRPE | [ ] | [ ] | ['Hypotrichosis 11'] |
| NM_001310338.1 (MGME1):c.743A>G (p.Tyr248Cys) | 587776944 | MGME1 | [ ] | [ ] | ['Mitochondrial DNA depletion syndrome 11'] |
| NM_000249.3 (MLH1):c.122A>G (p.Asp41Gly) | 63751094 | MLH1 | [ ] | [ ] | ['Hereditary Nonpolyposis Colorectal Neoplasms'] |
| NM_138425.3 (C12orf57):c.1A>G (p.Met1Val) | 587776954 | C12orf57 | [ ] | [ ] | ['Temtamy syndrome', 'Seizures', 'Corpus callosum abnormalities', 'Colobomatous microphthalmia', 'Global developmental delay'] |
| NM_000277.1 (PAH):c.1169A>G (p.Glu390Gly) | 5030856 | PAH | [ ] | ['CTCYCTGCCACGTAATACAGGGG', 'ACTCYCTGCCACGTAATACAGGG', 'AACTCYCTGCCACGTAATACAGG'] | ['Phenylketonuria', 'Hyperphenylalaninemia, non-pku', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000277.1 (PAH):c.1241A>G (p.Tyr414Cys) | 5030860 | PAH | [ ] | ['GGGTCGYAGCG AACTGAGAAGGG', 'TGGGTCGYAGCG AACTGAGAAGG'] | ['Phenylketonuria', 'Hyperphenylalaninemia, non-pku', 'not provided'] |
| NM_000155.3 (GALT):c.308A>G (p.Gln103Arg) | 367543252 | GALT | [ ] | [ ] | ['Deficiency of UDPglucose-hexose-1-phosphate uridylyltransferase'] |
| NM_207352.3 (CYP4V2):c.1091-2A>G | 199476183 | CYP4V2 | [ ] | [ ] | ['Bietti crystalline corneoretinal dystrophy'] |
| NM_000518.4 (HBB):c.*111A>G | 63751128 | HBB | [ ] | [ ] | [ ] |
| NM_000155.3 (GALT):c.857A>G (p.Tyr286Cys) | 367543262 | GALT | [ ] | [ ] | ['Deficiency of UDPglucose-hexose-1-phosphate uridylyltransferase'] |
| NM_000155.3 (GALT):c.854A>G (p.Lys285Arg) | 367543263 | GALT | [ ] | [ ] | ['Deficiency of UDPglucose-hexose-1-phosphate uridylyltransferase'] |
| NM_207352.3 (CYP4V2):c.761A>G (p.His254Arg) | 199476193 | CYP4V2 | [ ] | [ ] | ['Bietti crystalline corneoretinal dystrophy'] |
| NM_000155.3 (GALT):c.968A>G (p.Tyr323Cys) | 367543267 | GALT | [ ] | [ ] | ['Deficiency of UDPglucose-hexose-1-phosphate uridylyltransferase'] |
| NM_001142519.1 (FAM111A):c.1012A>G (p.Thr338Ala) | 587777014 | FAM111A | [ ] | [ ] | ['Gracile bone dysplasia'] |
| NM_000132.3 (F8):c.1660A>G (p.Ser554Gly) | 137852419 | F8 | ['AACYAGA GTAATAGC GGGTCAGG'] | ['AACYAGAGTAA TAGCGGGTCAGG'] | ['Hereditary factor VIII deficiency disease'] |
| NM_020988.2 (GNAO1):c.521A>G (p.Asp174Gly) | 587777055 | GNAO1 | [ ] | ['GGATGYCCTGCT CGGTGGGCTGG'] | ['Early infantile epileptic encephalopathy 17'] |
| NM_000155.3 (GALT):c.905-2A>G | 398123187 | GALT | [ ] | [ ] | ['Deficiency of UDPglucose-hexose-1-phosphate uridylyltransferase'] |
| NM_015662.2 (IFT172):c.4607T>C (p.Leu1536Pro) | 587777080 | IFT172 | [ ] | [ ] | [ ] |
| NM_014754.2 (PTDSS1):c.1058A>G (p.Gln353Arg) | 587777088 | PTDSS1 | [ ] | [ ] | [Lenz-Majewski hyperostosis syndrome'] |
| NM_003859.1 (DPM1):c.742T>C (p.Ser248Pro) | 587777114 | — | [ ] | [ ] | ['Congenital disorder of glycosylation type 1E'] |
| NM_001018005.1 (TPM1):c.742A>G (p.Lys248Glu) | 199476319 | TPM1 | [ ] | [ ] | ['Left ventricular noncompaction 9', 'not provided'] |
| NM_004826.3 (ECEL1):c.2278T>C (p.Cys760Arg) | 587777129 | ECEL1 | [ ] | [ ] | ['Arthrogryposis, distal, type 5d'] |
| NM_014908.3 (DOLK):c.2T>C (p.Met1Thr) | 587777137 | DOLK | [ ] | [ ] | ['Congenital disorder of glycosylation type 1M'] |
| NM_000350.2 (ABCA4):c.4540-2A>G | 61752435 | ABCA4 | [ ] | [ ] | ['Stargardt disease 1', 'not provided'] |
| NM_001128085.1 (ASPA):c.433-2A>G | 63751297 | — | [ ] | [ ] | ['Spongy degeneration of central nervous system'] |
| NM_176787.4 (PIGN):c.808T>C (p.Ser270Pro) | 587777186 | PIGN | [ ] | [ ] | ['Multiple congenital anomalies-hypotonia-seizures syndrome 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001165899.1 (PDE4D):c.1850T>C (p.Ile617Thr) | 587777188 | PDE4D | ['CTATAYT GTTCATCC CCTCTGGG', 'ACTATAYT GTTCATCC CCTCTGG'] | ['CTATAYTGTTCA TCCCCTCTGGG', 'ACTATAYTGTTC ATCCCCTCTGG'] | ['Acrodysostosis 2, with or without hormone resistance'] |
| NM_005017.3 (PCYT1A):c.571T>C (p.Phe191Leu) | 587777195 | PCYT1A | ['GCATGYT TGCTCCAA CACAGAGG'] | ['GCATGYTTGCTC CAACACAGAGG'] | ['Spondylometaphyseal dysplasia with cone-rod dystrophy'] |
| NM_024301.4 (FKRP):c.1A>G (p.Met1Val) | 587777223 | FKRP | [ ] | ['CCGCAYGGGGC CGAAGTCTGGG', 'GCCGCAYGGGGC CGAAGTCTGGG', 'AGCCGCAYGGGG CCGAAGTCTGG'] | ['Congenital muscular dystrophy—dystroglycanopathy with brain and eye anomalies type A5'] |
| NM_198947.3 (FAM111B):c.1879A>G (p.Arg627Gly) | 587777237 | FAM111B | [ ] | [ ] | ['Poikiloderma, hereditary fibrosing, with tendon contractures, myopathy, and pulmonary fibrosis'] |
| NM_003638.2 (ITGA8):c.2982+2T>C | 587777279 | ITGA8 | [ ] | [ ] | ['Renal adysplasia'] |
| NM_199189.2 (MATR3):c.1864A>G (p.Thr622Ala) | 587777301 | MATR3 | ['CGGYTGA ACTCTCAG TCTTCTGG'] | ['CGGYTGAACTCT CAGTCTTCTGG'] | ['Myopathy, distal, 2'] |
| NM_001739.1 (CA5A):c.697T>C (p.Ser233Pro) | 587777316 | CA5A | [ ] | [ ] | ['Carbonic anhydrase VA deficiency, hyperammonemia due to'] |
| NM_005051.2 (QARS):c.169T>C (p.Tyr57His) | 587777333 | QARS | [ ] | [ ] | ['Microcephaly, progressive, with seizures and cerebral and cerebellar atrophy'] |
| NM_002234.3 (KCNA5):c.143A>G (p.Glu48Gly) | 587777336 | KCNA5 | [ ] | [ ] | ['Atrial fibrillation, familial, 7'] |
| NM_021803.3 (IL21):c.146T>C (p.Leu49Pro) | 587777338 | IL21 | [ ] | [ ] | ['Common variable immunodeficiency 11'] |
| NM_000132.3 (F8):c.6794A>G (p.Gln2265Arg) | 137852470 | F8 | [ ] | [ ] | ['Hereditary factor VIII deficiency disease'] |
| NM_178014.3 (TUBB):c.895A>G (p.Met299Val) | 587777355 | TUBB | [ ] | [ ] | ['Cortical dysplasia, complex, with other brain malformations 6'] |
| NM_005957.4 (MTHFR):c.1969T>C (p.Ter657Arg) | 768434408 | MTHFR | [ ] | [ ] | ['Homocysteinemia due to MTHFR deficiency'] |
| NM_005359.5 (SMAD4):c.425-6A>G | 377767327 | SMAD4 | [ ] | [ ] | ['Juvenile polyposis syndrome'] |
| NM_022068.3 (PIEZO2):c.8215T>C (p.Ser2739Pro) | 587777454 | PIEZO2 | [ ] | [ ] | ['Oculomelic amyoplasia'] |
| NM_003108.3 (SOX11):c.347A>G (p.Tyr116Cys) | 587777479 | SOX11 | [ ] | ['GTACTTGYAGTC GGGGTAGTCGG'] | ['Mental retardation, autosomal dominant 27'] |
| NM_021072.3 (HCN1):c.814T>C (p.Ser272Pro) | 587777493 | HCN1 | [ ] | [ ] | ['Epileptic encephalopathy, early infantile, 24'] |
| NM_020435.3 (GJC2):c.-170A>G | 587777496 | GJC2 | [ ] | ['TTGYTCCCCCCT CGGCCTCAGGG', 'ATTGYTCCCCCCT CGGCCTCAGG'] | ['Leukodystrophy, hypomyelinating, 2'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_022552.4 (DNMT3A):c.1943T>C (p.Leu648Pro) | 587777507 | DNMT3A | [ ] | ['CTCCYGGTGCTG AAGGACTTGGG', 'GCTCCYGGTGCT GAAGGACTTGG'] | ['Tatton-Brown-rahman syndrome'] |
| NM_022552.4 (DNMT3A):c.2705T>C (p.Phe902Ser) | 587777510 | DNMT3A | [ ] | [ ] | ['Tatton-Brown-rahman syndrome'] |
| NM_000223.3 (KRT12):c.403A>G (p.Arg135Gly) | 58410481 | KRT12 | [ ] | [ ] | ['Meesman corneal dystrophy', 'not provided'] |
| NM_000232.4 (SGCB):c.1A>G (p.Met1Val) | 398123262 | SGCB | [ ] | [ ] | ['Limb-girdle muscular dystrophy, type 2E', 'not provided'] |
| NM_020630.4 (RET):c.2342A>G (p.Gln781Arg) | 377767416 | RET | [ ] | [ ] | ['MEN2 phenotype: Unclassified'] |
| NM_018400.3 (SCN3B):c.482T>C (p.Met161Thr) | 587777557 | SCN3B | [ ] | ['AATCAYGATGTA CATCCTTCTGG'] | ['Atrial fibrillation, familial, 16'] |
| NM_001030001.2 (RPS29):c.149T>C (p.Ile50Thr) | 587777569 | RPS29 | [ ] | ['GATAYCGGTTTC ATTAAGGTAGG'] | ['Diamond-Blackfan anemia 13'] |
| NM_177550.4 (SLC13A5):c.1463T>C (p.Leu488Pro) | 587777578 | SLC13A5 | [ ] | [ ] | ['Epileptic encephalopathy, early infantile, 25'] |
| NM_002880.3 (RAF1):c.1808T>C (p.Leu603Pro) | 587777586 | RAF1 | [ ] | [ ] | ['Cardiomyopathy, dilated, 1NN'] |
| NM_025150.4 (TARS2):c.695+3A>G | 587777594 | TARS2 | [ ] | [ ] | ['Combined oxidative phosphorylation deficiency 21'] |
| NM_001759.3 (CCND2):c.838A>G (p.Thr280Ala) | 587777618 | CCND2 | [ ] | [ ] | Negalencephaly-polymicrogyria-polydactyly-hydrocephalus syndrome 3'] |
| NM_153334.6 (SCARF2):c.190T>C (p.Cys64Arg) | 587777657 | SCARF2 | [ ] | ['CCACGYGCTGCG CTGGCTGGAGG'] | ['Marden Walker like syndrome'] |
| NM_005726.5 (TSFM):c.57+4A>G | 587777689 | TSFM | [ ] | ['ACTTCYCACCGG GTAGCTCCCGG'] | ['Combined oxidative phosphorylation deficiency 3'] |
| NM_000255.3 (MUT):c.329A>G (p.Tyr110Cys) | 796052005 | MUT | [ ] | ['GCAYACTGGCG GATGGTCCAGGG', 'AGCAYACTGGCG GATGGTCCAGG'] | ['not provided'] |
| NM_021870.2 (FGG):c.1210T>C (p.Ser404Pro) | 587777720 | FGG | [ ] | [ ] | ['Hypodysfibrinogenemia'] |
| NM_017617.3 (NOTCH1):c.1285T>C (p.Cys429Arg) | 587777736 | NOTCH1 | ['GGCAAGY GCATCAAC ACGCTGGG'] | ['GGCAAGYGCAT CAACACGCTGGG', 'GGGCAAGYGCAT CAACACGCTGG'] | ['Adams-Oliver syndrome 1', 'Adams-Oliver syndrome 5'] |
| NM_014946.3 (SPAST):c.1688-2A>G | 587777752 | SPAST | ['TTCYGTA AAACATAA AAGTCAGG'] | ['TTCYGTAAAACA TAAAAGTCAGG'] | ['Spastic paraplegia 4, autosomal dominant'] |
| NM_014946.3 (SPAST):c.1245+4A>G | 587777755 | SPAST | [ ] | [ ] | ['Spastic paraplegia 4, autosomal dominant'] |
| NM_014946.3 (SPAST):c.1216A>G (p.Ile406Val) | 587777757 | SPAST | [ ] | [ ] | ['Spastic paraplegia 4, autosomal dominant'] |
| NM_144596.3 (TTC8):c.115-2A>G | 587777809 | TTC8 | [ ] | ['GTTCCYGGAAA GCATTAAGAGAGG'] | ['Retinitis pigmentosa 51'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_170784.2 (MKKS):c.110A>G (p.Tyr37Cys) | 74315396 | MKKS | [ ] | [ ] | ['Bardet-Biedl syndrome 6', 'McKusick Kaufman syndrome'] |
| NM_000252.2 (MTM1):c.566A>G (p.Asn189Ser) | 132630302 | MTM1 | [ ] | [ ] | ['Severe X-linked myotubular myopathy'] |
| NM_000252.2 (MTM1):c.1190A>G (p.Tyr397Cys) | 132630303 | MTM1 | [ ] | [ ] | ['Severe X-linked myotubular myopathy'] |
| NM_152384.2(BBS5): c.522+3A>G | 587777828 | BBS5 | [ ] | [ ] | ['Bardet-Biedl syndrome 5'] |
| NM_001205019.1 (GK):c.880A>G (p.Asn294Asp) | 132630331 | GK | [ ] | [ ] | ['Deficiency of glycerol kinase'] |
| NM_000166.5 (GJB1):c.580A>G (p.Met194Val) | 587777878 | GJB1 | [ ] | ['TAGCAYGAAGA CGGTGAAGACGG'] | ['X-linked hereditary motor and sensory neuropathy'] |
| NM_000311.3 (PRNP):c.547A>G (p.Thr183Ala) | 74315411 | PRNP | [ ] | [ ] | ['Genetic prion diseases', 'Spongiform encephalopathy with neuropsychiatric features'] |
| NM_144773.2 (PROKR2):c.629A>G (p.Gln210Arg) | 74315417 | PROKR2 | [ ] | [ ] | ['Kallmann syndrome 3'] |
| NM_000531.5 (OTC):c.919A>G (p.Lys307Glu) | 796052013 | OTC | [ ] | [ ] | ['not provided'] |
| NM_001029871.3 (RSPO4):c.194A>G (p.Gln65Arg) | 74315420 | RSPO4 | [ ] | ['CGTACYGGCGG ATGCCTTCCCGG'] | ['Anonychia'] |
| NM_004333.4 (BRAF):c.770A>G (p.Gln257Arg) | 180177035 | BRAF | [ ] | [ ] | ['Noonan syndrome 7', 'Cardiofaciocutaneous syndrome', 'Rasopathy', 'not provided'] |
| NM_004333.4 (BRAF):c.1495A>G (p.Lys499Glu) | 180177037 | BRAF | [ ] | [ ] | ['Cardiofaciocutaneous syndrome', 'Rasopathy'] |
| NM_198056.2 (SCN5A):c.5297T>A (p.Met1766Lys) | 752476527 | SCN5A | [ ] | [ ] | ['not provided'] |
| NM_000030.2 (AGXT):c.248A>G (p.His83Arg) | 180177186 | AGXT | [ ] | [ ] | ['Primary hyperoxaluria, type I'] |
| NM_000030.2 (AGXT):c.424-2A>G (p.Gly_142Gln145del) | 180177219 | AGXT | [ ] | ['AGGCCCYGAGG AAGCAGGGACGG'] | ['Primary hyperoxaluria, type I'] |
| NM_198578.3 (LRRK2):c.5096A>G (p.Tyr1699Cys) | 35801418 | LRRK2 | [ ] | [ ] | ['Parkinson disease 8, autosomal dominant'] |
| NM_002693.2 (POLG):c.1808T>C (p.Met603Thr) | 367610201 | POLG | [ ] | ['CTCAYGGCACTT ACCTGGGATGG'] | ['not provided'] |
| NM_000030.2 (AGXT):c.596-2A>G | 180177245 | AGXT | [ ] | [ ] | ['Primary hyperoxaluria, type I'] |
| NM_020223.3 (FAM20C):c.1364-2A>G | 796051853 | FAM20C | [ ] | [ ] | ['Raine syndrome'] |
| NM_012203.1 (GRHPR):c.84-2A>G | 180177319 | GRHPR | [ ] | ['TCACAGCYGCG GGGAAAGGGAGG'] | ['Primary hyperoxaluria, type II'] |
| NM_006017.2 (PROM1):c.2077-521A>G | 796051882 | PROM1 | [ ] | [ ] | ['Cone-rod dystrophy 2'] |
| NM_012203.1 (GRHPR):c.934A>G (p.Asn312Asp) | 180177324 | GRHPR | ['CAAGTYG TTAGCTGC CAACAAGG'] | ['CAAGTYGTTAGC TGCCAACAAGG'] | ['Primary hyperoxaluria, type II'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000016.5 (ACADM):c.329A>G (p.Glu110Gly) | 796051900 | ACADM | [ ] | [ ] | ['not provided'] |
| NM_004453.3 (ETFDH):c.929A>G (p.Tyr310Cys) | 796051958 | ETFDH | [ ] | [ ] | ['not provided'] |
| NM_000255.3 (MUT):c.1885A>G (p.Arg629Gly) | 796052004 | MUT | [ ] | [ ] | ['not provided'] |
| NM_012434.4 (SLC17A5):c.548A>G (p.His183Arg) | 119491109 | SLC17A5 | [ ] | [ ] | ['Sialic acid storage disease, severe infantile type'] |
| NM_000328.2 (RPGR):c.155-2A>G | 62638632 | RPGR | [ ] | [ ] | ['Retinitis pigmentosa 15', 'not provided'] |
| NM_005557.3 (KRT16):c.373A>G (p.Asn125Asp) | 58608173 | KRT16 | [ ] | [ ] | ['Pachyonychia congenita, type 1', 'not provided'] |
| NM_000532.4 (PCCB):c.655-2A>G | 796052020 | PCCB | [ ] | [ ] | ['not provided'] |
| NM_000030.2 (AGXT):c.777-2A>G | 796052068 | AGXT | [ ] | ['GGTACCYGGAA GACACGAGGGGG', 'TGGTACCYGGAA GACACGAGGGG'] | ['Primary hyperoxaluria, type I'] |
| NM_000121.3 (EPOR):c.1460A>G (p.Asn487Ser) | 62638745 | EPOR | ['AGGGYTG GAGTAGGG GCCATCGG'] | ['AGGGYTGGAGT AGGGGCCATCGG'] | ['Acute myeloid leukemia, M6 type', 'Familial erythrocytosis, 1'] |
| NM_000552.3 (VWF):c.1583A>G (p.Asn528Ser) | 61754010 | VWF | [ ] | ['TGCCAYTGTAAT TCCCACACAGG'] | ['von Willebrand disease, type 2a', 'not provided'] |
| NM_001918.3 (DBT): c.1017_1018insNC_000001.11: g.100207187_100202312 | 796052135 | DBT | [ ] | [ ] | ['Intermediate maple syrup urine disease type 2'] |
| NM_001243473.1 (B9D1):c.400+2T>C | 143149764 | B9D1 | [ ] | [ ] | ['Meckel syndrome, type 9', 'not provided'] |
| NM_001165963.1 (SCN1A):c.4766T>G (p.Val1589Gly) | 764037830 | — | [ ] | [ ] | ['Severe myoclonic epilepsy in infancy'] |
| NM_000321.2 (RB1):c.1927A>G (p.Lys643Glu) | 587778866 | RB1 | [ ] | ['ATTYCAATGGCT TCTGGGTCTGG'] | ['Retinoblastoma'] |
| NM_006331.7 (EMG1):c.257A>G (p.Asp86Gly) | 74435397 | EMG1 | [ ] | ['ATAYCTGGCCGC GCTTCCCCAGG'] | ['Bowen-Conradi syndrome'] |
| NM_000249.3 (MLH1):c.113A>G (p.Asn38Ser) | 587778888 | MLH1 | [ ] | [ ] | ['Hereditary Nonpolyposis Colorectal Neoplasms'] |
| NM_017777.3 (MKS1):c.1382A>G (p.Tyr461Cys) | 730882120 | MKS1 | [ ] | [ ] | ['Bardet-Biedl syndrome 13'] |
| NM_000261.1 (MYOC):c.1010A>G (p.Gln337Arg) | 74315335 | MYOC | [ ] | [ ] | ['Primary open angle glaucoma juvenile onset 1'] |
| NM_152515.4 (CKAP2L):c.2T>C (p.Met1Thr) | 548949031 | CKAP2L | [ ] | [ ] | ['Filippi syndrome'] |
| NM_000156.5 (GAMT):c.1A>G (p.Met1Val) | 796052527 | GAMT | [ ] | ['CGCTCAYGCTGC AGGCTGGACGG'] | ['not provided'] |
| NM_000833.4 (GRIN2A):c.1930A>G (p.Ser644Gly) | 796052544 | GRIN2A | [ ] | [ ] | ['not provided'] |
| NM_000144.4 (FXN):c.385-2A>G | 140987490 | FXN | [ ] | [ ] | ['Friedreich ataxia'] |
| NM_172107.2 (KCNQ2):c.297-2A>G | 796052615 | KCNQ2 | [ ] | [ ] | ['not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_172107.2 (KCNQ2):c.611A>G (p.Gln204Arg) | 796052624 | KCNQ2 | [ ] | [ ] | ['not provided'] |
| NM_172107.2 (KCNQ2):c.848A>G (p.Lys283Arg) | 796052637 | KCNQ2 | [ ] | ['GTACYTGTCCCC GTAGCCAATGG'] | ['not provided'] |
| NM_052859.3 (RFT1):c.887T>A (p.Ile296Lys) | 772820136 | RFT1 | [ ] | [ ] | ['Congenital disorder of glycosylation type 1N'] |
| NM_000553.4 (WRN):c.561A>G (p.Lys187=) | 775802030 | WRN | [ ] | [ ] | ['Werner syndrome'] |
| NM_194277.2 (FRMD7):c.556A>G (p.Met186Val) | 786205896 | FRMD7 | [ ] | [ ] | ['Infantile nystagmus, X-linked'] |
| NM_000535.5 (PMS2):c.989-2A>G | 587779347 | PMS2 | [ ] | [ ] | ['Hereditary Nonpolyposis Colorectal Neoplasms', 'Hereditary cancer-predisposing syndrome'] |
| NM_000203.4 (IDUA):c.1874A>G (p.Tyr625Cys) | 587779401 | IDUA | [ ] | [ ] | ['Hurler syndrome'] |
| NM_001105243.1 (PCDH19):c.1019A>G (p.Asn340Ser) | 796052839 | PCDH19 | [ ] | [ ] | ['not provided'] |
| NM_002693.2 (POLG):c.2840A>G (p.Lys947Arg) | 796052891 | POLG | [ ] | [ ] | ['not provided'] |
| NM_032228.5 (FAR1):c.1094A>G (p.Asp365Gly) | 724159963 | FAR1 | [ ] | ['GATAYCATACA GGAATGCTGGGG', 'AGATAYCATACA GGAATGCTGGG', 'TAGATAYCATAC AGGAATGCTGG'] | ['Peroxisomal fatty acyl-coa reductase 1 disorder'] |
| NM_000090.3 (COL3A1):c.2284-2A>G (p.Gly762_Lys779del) | 587779558 | COL3A1 | [ ] | [ ] | ['Ehlers-Danlos syndrome, type 4'] |
| NM_014305.3 (TGDS):c.269A>G (p.Glu90Gly) | 724160004 | TGDS | [ ] | [ ] | ['Catel Manzke syndrome'] |
| NM_014305.3 (TGDS):c.892A>G (p.Asn298Asp) | 724160005 | TGDS | [ ] | [ ] | ['Catel Manzke syndrome'] |
| NM_000090.3 (COL3A1):c.997-2A>G (p.Gly333_Lys350del+) | 587779602 | COL3A1 | [ ] | [ ] | ['Ehlers-Danlos syndrome, type 4'] |
| NM_002185.3 (IL7R):c.197T>C (p.Ile66Thr) | 1494558 | IL7R | [ ] | [ ] | ['Severe combined immunodeficiency, autosomal recessive, T cell-negative, B cell-positive, NK cell-positive', 'not specified'] |
| NM_000277.1 (PAH):c.974A>G (p.Tyr325Cys) | 62508578 | PAH | [ ] | [ ] | ['Phenylketonuria', 'not provided'] |
| NM_000090.3 (COL3A1):c.997-10A>G (p.Pro332_Gly333insFFQ) | 587779670 | COL3A1 | [ ] | [ ] | ['Ehlers-Danlos syndrome, type 4'] |
| NM_000090.3 (COL3A1):c.3202-2A>G (p.Gly1068_Pro1085del) | 587779682 | COL3A1 | [ ] | [ ] | ['Ehlers-Danlos syndrome, type 4'] |
| NM_000090.3 (COL3A1):c.1762-2A>G (p.Gly588_Gln605del) | 587779722 | COL3A1 | [ ] | ['CACCCYAAAGA AGAAGTGGTCGG'] | ['Ehlers-Danlos syndrome, type 4'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_021007.2 (SCN2A):c.4036A>G (p.Ile1346Val) | 796053135 | SCN2A | [ ] | [ ] | ['not provided'] |
| m.13637A>G | 200855215 | MT-ND5 | [ ] | [ ] | ['Leber optic atrophy'] |
| NM_021007.2 (SCN2A):c.387-2A>G | 796053169 | SCN2A | ['AATAAAG YAGAATAT CGTCAAGG'] | ['AATAAAGYAGA ATATCGTCAAGG'] | ['not provided'] |
| NM_021007.2 (SCN2A):c.851A>G (p.Asp284Gly) | 796053173 | SCN2A | [ ] | [ ] | ['not provided'] |
| NM_006516.2 (SLC2A1):c.848A>G (p.Gln283Arg) | 796053251 | SLC2A1 | [ ] | [ ] | ['not provided'] |
| NM_006516.2 (SLC2A1):c.19-2A>G | 796053272 | SLC2A1 | [ ] | [ ] | ['not provided'] |
| NM_000136.2 (FANCC):c.-78-2A>G | 587779898 | FANCC | [ ] | [ ] | ['Hereditary cancer-predisposing syndrome'] |
| m.8296A>G | 118192102 | MT-TK | [ ] | ['TTTACAGYGGGC TCTAGAGGGGG'] | ['Diabetes-deafness syndrome maternally transmitted'] |
| NM_005360.4 (MAF):c.172A>G (p.Thr58Ala) | 727502767 | MAF | [ ] | [ ] | ['Cataracts, congenital, with sensorineural deafness, down syndrome-like facial appearance, short stature, and mental retardation'] |
| NM_001145901.1 (SARS2):c.1175A>G (p.Asp392Gly) | 727502784 | SARS2 | [ ] | [ ] | ['Hyperuricemia, pulmonary hypertension, renal failure, and alkalosis'] |
| NM_001077494.3 (NFKB2):c.2594A>G (p.Asp865Gly) | 727502787 | NFKB2 | [ ] | ['CTGYCTTCCTTC ACCTCTGCTGG'] | ['Common variable immunodeficiency 10'] |
| NM_002238.3 (KCNH1):c.1399A>G (p.Ile467Val) | 727502819 | KCNH1 | [ ] | [ ] | ['Zimmermann-Laband syndrome', 'Temple-Baraitser syndrome'] |
| NM_172362.2 (KCNH1):c.1508A>G (p.Gln503Arg) | 727502821 | KCNH1 | [ ] | [ ] | ['Temple-Baraitser syndrome'] |
| NM_000546.5 (TP53):c.701A>G (p.Tyr234Cys) | 587780073 | TP53 | [ ] | [ ] | ['Li-Fraumeni syndrome', 'Hereditary cancer-predisposing syndrome'] |
| NM_003060.3 (SLC22A5):c.694A>C (p.Thr232Pro) | 188698686 | SLC22A5 | [ ] | [ ] | ['not provided'] |
| NM_000540.2 (RYR1):c.14591A>G (p.Tyr4864Cys) | 118192146 | RYR1 | [ ] | [ ] | ['Central core disease', 'not provided'] |
| NM_058216.2 (RAD51C):c.706-2A>G | 587780259 | RAD51C | [ ] | [ ] | ['Hereditary cancer-predisposing syndrome'] |
| NM_000501.3 (ELN):c.800-2A>G | 727503027 | ELN | [ ] | [ ] | ['Supravalvar aortic stenosis', 'not provided'] |
| NM_000117.2 (EMD):c.266-2A>G | 727503036 | EMD | [ ] | ['AGCCYTGGGAA GGGGGGCAGCGG'] | [Emery-Dreifuss muscular dystrophy 1, X-linked'] |
| NM_003242.5 (TGFBR2):c.1273A>G (p.Met425Val) | 104893817 | TGFBR2 | [ ] | [ ] | ['Loeys-Dietz syndrome 2'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_153638.2 (PANK2):c.700A>G (p.Thr234Ala) | 137852965 | PANK2 | [ ] | [ ] | [ ] |
| NM_005861.3 (STUB1):c.194A>G (p.Asn65Ser) | 690016544 | STUB1 | [ ] | ['GGCCCGGYTGGT GTAATACACGG'] | ['Spinocerebellar ataxia, autosomal recessive 16'] |
| NM_005360.4 (MAF):c.890A>G (p.Lys297Arg) | 121917736 | MAF | [ ] | [ ] | ['Cataract, pulverulent, juvenile-onset'] |
| NM_005211.3 (CSF1R):c.2655-2A>G | 690016554 | CSF1R | [ ] | ['GTATCYGGGAG ATAGGACAGAGG'] | ['Hereditary diffuse leukoencephalopathy with spheroids'] |
| NM_003361.3 (UMOD):c.383A>G (p.Asn128Ser) | 121917770 | UMOD | ['CACAYTG ACACATGT GGCCAGGG'] | ['CACAYTGACAC ATGTGGCCAGGG', 'CCACAYTGACAC ATGTGGCCAGG'] | ['Familial juvenile gout'] |
| NM_000256.3 (MYBPC3):c.2234A>G (p.Asp745Gly) | 727503190 | MYBPC3 | [ ] | [ ] | ['Familial hypertrophic cardiomyopathy 4', 'Familial hypertrophic cardiomyopathy 1', 'not specified'] |
| NM_172107.2 (KCNQ2):c.1A>G (p.Met1Val) | 118192185 | KCNQ2 | [ ] | ['GCACCAYGGTG CCTGGCGGGAGG'] | ['Benign familial neonatal seizures 1'] |
| NM_000256.3 (MYBPC3):c.1213A>G (p.Met405Val) | 727503207 | MYBPC3 | [ ] | [ ] | ['Cardiomyopathy', 'not specified'] |
| NM_000021.3 (PSEN1):c.998A>G (p.Asp333Gly) | 121917809 | PSEN1 | [ ] | [ ] | ['Primary dilated cardiomyopathy', 'Cardiomyopathy, dilated, 1u', 'Heart failure'] |
| NM_021954.3 (GJA3):c.188A>G (p.Asn63Ser) | 121917823 | GJA3 | [ ] | [ ] | ['Zonular pulverulent cataract 3'] |
| NM_000322.4 (PRPH2):c.422A>G (p.Tyr141Cys) | 61755781 | PRPH2 | [ ] | [ ] | ['Macular dystrophy, vitelliform, adult-onset', 'Patterned dystrophy of retinal pigment epithelium', 'not provided'] |
| NM_007035.3 (KERA):c.740A>G (p.Asn247Ser) | 121917858 | KERA | [ ] | [ ] | ['Cornea plana 2'] |
| NM_002181.3 (IHH):c.284A>G (p.Glu95Gly) | 121917859 | IHH | [ ] | [ ] | ['Brachydactyly type A1'] |
| NM_000257.3 (MYH7):c.1157A>G (p.Tyr386Cys) | 727503269 | MYH7 | [ ] | [ ] | ['Primary familial hypertrophic cardiomyopathy'] |
| NM_000097.5 (CPOX):c.1210A>G (p.Lys404Glu) | 121917868 | CPOX | [ ] | [ ] | ['Harderoporphyria'] |
| NM_012064.3 (MIP):c.401A>G (p.Glu134Gly) | 121917869 | MIP | [ ] | ['AGATCYCCACTG TGGTTGCCTGG'] | ['Cataract 15, multiple types'] |
| NM_025243.3 (SLC19A3):c.1264A>G (p.Thr422Ala) | 121917884 | SLC19A3 | [ ] | [ ] | ['Basal ganglia disease, biotin-responsive'] |
| NM_000373.3 (UMPS):c.286A>G (p.Arg96Gly) | 121917890 | UMPS | [ ] | [ ] | ['Orotic aciduria'] |
| NM_000536.3 (RAG2):c.115A>G (p.Arg39Gly) | 121917897 | RAG2 | [ ] | [ ] | ['Histiocytic medullary reticulosis'] |
| NM_130838.1 (UBE3A):c.1694-2A>G | 587780579 | UBE3A | [ ] | [ ] | ['Angelman syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_016335.4 (PRODH):c.1322T>C (p.Leu441Pro) | 2904551 | PRODH | [ ] | [ ] | ['Proline dehydrogenase deficiency', 'Schizophrenia 4'] |
| NM_006920.4 (SCN1A):c.4352A>G (p.Tyr1451Cys) | 121917962 | — | [ ] | [ ] | ['Severe myoclonic epilepsy in infancy', 'not provided'] |
| NM_006920.4 (SCN1A):c.1876A>G (p.Ser626Gly) | 121917990 | SCN1A | [ ] | [ ] | ['Severe myoclonic epilepsy in infancy', 'Generalized epilepsy'] |
| NM_000478.4 (ALPL):c.1250A>G (p.Asn417Ser) | 121918014 | ALPL | [ ] | ['AGGCCCAYTGCC ATACAGGATGG'] | ['Infantile hypophosphatasia'] |
| NM_000174.4 (GP9):c.110A>G (p.Asp37Gly) | 121918036 | GP9 | [ ] | ['GCAGYCCACCC ACAGCCCCATGG'] | ['Bernard-Soulier syndrome type C'] |
| NM_002693.2 (POLG):c.2591A>G (p.Asn864Ser) | 121918050 | POLG | [ ] | [ ] | ['Mitochondrial DNA depletion syndrome 4B, MNGIE type'] |
| NM_000374.4 (UROD):c.932A>G (p.Tyr311Cys) | 121918061 | UROD | [ ] | [ ] | ['Hepatoerythropoietic porphyria'] |
| NM_000217.2 (KCNA1):c.763A>G (p.Asn255Asp) | 121918067 | KCNA1 | [ ] | [ ] | [ ] |
| NM_000371.3 (TTR):c.238A>G (p.Thr80Ala) | 121918070 | TTR | [ ] | [ ] | ['Amyloidogenic transthyretin amyloidosis', 'Cardiomyopathy'] |
| NM_000371.3 (TTR):c.401A>G (p.Tyr134Cys) | 121918075 | TTR | ['GGAGYAG GGGCTCAG CAGGGCGG', 'ATAGGAG YAGGGGCT CAGCAGGG'] | ['GGAGYAGGGGC TCAGCAGGGCGG', 'ATAGGAGYAGGG GCTCAGCAGGG'] | ['Amyloidogenic transthyretin amyloidosis'] |
| NM_000371.3 (TTR):c.205A>G (p.Thr69Ala) | 121918081 | TTR | [ ] | [ ] | ['Amyloidogenic transthyretin amyloidosis'] |
| NM_000371.3 (TTR):c.379A>G (p.Ile127Val) | 121918089 | TTR | [ ] | ['CGGCAAYGGTG TAGCGGCGGGGG', 'GCGGCAAYGGTG TAGCGGCGGGG'] | ['Amyloidogenic transthyretin amyloidosis'] |
| NM_000371.3 (TTR):c.113A>G (p.Asp38Gly) | 121918098 | TTR | [ ] | [ ] | ['Amyloidogenic transthyretin amyloidosis', 'AMYLOIDOSIS, LEPTOMENINGEAL, TRANSTHYRETIN-RELATED'] |
| NM_000823.3 (GHRHR):c.985A>G (p.Lys329Glu) | 121918121 | GHRHR | [ ] | ['CGACTYGGAGA GACGCCTGCAGG'] | ['Isolated growth hormone deficiency type 1B'] |
| NM_000275.2 (OCA2):c.1465A>G (p.Asn489Asp) | 121918170 | OCA2 | ['GACATYT GGAGGGTC CCCGATGG'] | ['GACATYTGGAG GGTCCCCGATGG'] | ['Tyrosinase-positive oculocutaneous albinism'] |
| NM_000181.3 (GUSB):c.1484A>G (p.Tyr495Cys) | 121918178 | GUSB | [ ] | [ ] | ['Mucopolysaccharidosis type VII'] |
| NM_018122.4 (DARS2):c.133A>G (p.Ser45Gly) | 121918209 | DARS2 | [ ] | [ ] | ['Leukoencephalopathy with Brainstem and Spinal Cord Involvement and Lactate Elevation'] |
| NM_015697.7 (COQ2):c.890A>G (p.Tyr297Cys) | 121918230 | COQ2 | [ ] | [ ] | ['Coenzyme Q10 deficiency, primary 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_015697.7 (COQ2):c.683A>G (p.Asn228Ser) | 121918232 | COQ2 | [ ] | [ ] | ['Coenzyme Q10 deficiency, primary 1'] |
| NM_015384.4 (NIPBL):c.7289A>G (p.Tyr2430Cys) | 121918265 | NIPBL | [ ] | [ ] | ['Cornelia de Lange syndrome 1'] |
| NM_004183.3 (BEST1):c.707A>G (p.Tyr236Cys) | 121918291 | BEST1 | [ ] | [ ] | ['Vitreoretinochoroidopathy dominant'] |
| NM_014362.3 (HIBCH):c.365A>G (p.Tyr122Cys) | 121918329 | HIBCH | [ ] | [ ] | [Beta-hydroxyisobutyryl-CoA deacylase deficiency'] |
| NM_015335.4 (MED13L):c.6068A>G (p.Asp2023Gly) | 121918333 | MED13L | [ ] | ['ATATCAYCTAGA GGGAAGGGGGG', 'CATATCAYCTAG AGGGAAGGGGG'] | ['Transposition of great arteries'] |
| NM_015040.3 (PIKFYVE):c.3308A>G (p.Lys1103Arg) | 121918336 | PIKFYVE | [ ] | [ ] | ['Fleck corneal dystrophy'] |
| NM_006306.3 (SMC1A):c.2974-2A>G | 727503774 | SMC1A | [ ] | [ ] | ['Congenital muscular hypertrophy-cerebral syndrome'] |
| NM_002633.2 (PGM1):c.343A>G (p.Thr115Ala) | 121918371 | PGM1 | [ ] | [ ] | ['Congenital disorder of glycosylation type 1t'] |
| NM_000040.1 (APOC3):c.280A>G (p.Thr94Ala) | 121918381 | APOC3 | ['CTGAAGY TGGTCTGA CCTCAGGG', 'GCTGAAG YTGGTCTG ACCTCAGG'] | ['CTGAAGYTGGTC TGACCTCAGGG', 'GCTGAAGYTGGT CTGACCTCAGG'] | [ ] |
| NM_000040.1 (APOC3):c.232A>G (p.Lys78Glu) | 121918382 | APOC3 | [ ] | [ ] | ['Hyperalphalipo-proteinemia 2'] |
| NM_001146040.1 (GLRA1):c.910A>G (p.Lys304Glu) | 121918412 | GLRA1 | [ ] | [ ] | ['Hyperekplexia hereditary'] |
| NM_000171.3 (GLRA1):c.523A>G (p.Met175Val) | 121918414 | GLRA1 | [ ] | [ ] | ['Hyperekplexia hereditary'] |
| NM_021957.3 (GYS2):c.116A>G (p.Asn39Ser) | 121918423 | GYS2 | [ ] | [ ] | ['Hypoglycemia with deficiency of glycogen synthetase in the liver'] |
| NM_002834.3 (PTPN11):c.188A>G (p.Tyr63Cys) | 121918459 | PTPN11 | [ ] | [ ] | ['Noonan syndrome', 'Noonan syndrome 1', 'Rasopathy', 'not provided'] |
| NM_013382.5 (POMT2):c.1726-2A>G | 727503873 | POMT2 | [ ] | [ ] | ['not provided'] |
| NM_002834.3 (PTPN11):c.236A>G (p.Gln79Arg) | 121918466 | PTPN11 | [ ] | [ ] | ['Noonan syndrome', 'Noonan syndrome 1', 'Rasopathy', 'not provided'] |
| NM_000313.3 (PROS1):c.773A>G (p.Asn258Ser) | 121918473 | PROS1 | [ ] | [ ] | ['Protein S deficiency'] |
| NM_000313.3 (PROS1):c.586A>G (p.Lys196Glu) | 121918474 | PROS1 | [ ] | [ ] | ['Protein S deficiency'] |
| NM_000141.4 (FGFR2):c.983A>G (p.Tyr328Cys) | 121918493 | FGFR2 | [ ] | [ ] | ['Crouzon syndrome'] |
| NM_000141.4 (FGFR2):c.874A>G (p.Lys292Glu) | 121918500 | FGFR2 | ['TGCTYGA TCCACTGG ATGTGGGG'] | ['TGCTYGATCCAC TGGATGTGGGG', 'GTGCTYGATCCA CTGGATGTGGG', | ['Crouzon syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000141.4 (FGFR2):c.1576A>G (p.Lys526Glu) | 121918507 | FGFR2 | [ ] | ['CGTGCTYGATCC ACTGGATGTGG'] [ ] | ['Crouzon syndrome', 'Scaphocephaly, maxillary retrusion, and mental retardation'] |
| NM_002739.3 (PRKCG):c.380A>G (p.Gln127Arg) | 121918515 | PRKCG | [ ] | [ ] | ['Spinocerebellar ataxia 14'] |
| NM_002739.3 (PRKCG):c.1081A>G (p.Ser361Gly) | 121918517 | PRKCG | [ ] | [ ] | ['Spinocerebellar ataxia 14'] |
| NM_000098.2 (CPT2):c.359A>G (p.Tyr120Cys) | 121918528 | CPT2 | ['GATAGGY ACATATCA AACCAGGG', 'AGATAGG YACATATC AAACCAGG'] | ['GATAGGYACAT ATCAAACCAGGG', 'AGATAGGYACAT ATCAAACCAGG'] | ['Carnitine palmitoyltransferase II deficiency, infantile'] |
| NM_005587.2 (MEF2A):c.788A>G (p.Asn263Ser) | 121918530 | MEF2A | ['CCAAGAY TACCACCA CCTGGTGG'] | ['AGAYTACCACC ACCTGGTGGAGG', 'CCAAGAYTACCA CCACCTGGTGG'] | [ ] |
| NM_006204.3 (PDE6C):c.1363A>G (p.Met455Val) | 121918539 | PDE6C | [ ] | [ ] | ['Achromatopsia 5'] |
| NM_017654.3 (SAMD9):c.4483A>G (p.Lys1495Glu) | 121918554 | SAMD9 | [ ] | [ ] | ['Tumoral calcinosis, familial, normophosphatemic'] |
| NM_000191.2 (HMGCL):c.698A>G (p.His233Arg) | 727503963 | HMGCL | [ ] | [ ] | ['not provided'] |
| NM_020166.4 (MCCC1):c.137-2A>G | 727504006 | MCCC1 | [ ] | [ ] | ['3 Methylcrotonyl-CoA carboxylase 1 deficiency', 'not provided'] |
| NM_001035.2 (RYR2):c.12602A>G (p.Gln4201Arg) | 121918605 | RYR2 | [ ] | ['CGCCAGCYGCAT TCAAAGATGG'] | ['Catecholaminergic polymorphic ventricular tachycardia'] |
| NM_002764.3 (PRPS1):c.343A>G (p.Met115Val) | 587781262 | PRPS1 | [ ] | ['TAGCAYATTTGC AACAAGCTTGG'] | ['Charcot-Marie-Tooth disease, X-linked recessive, type 5', 'Deafness, high-frequency sensorineural, X-linked'] |
| NM_001161766.1 (AHCY):c.344A>G (p.Tyr115Cys) | 121918608 | AHCY | [ ] | ['GCGGGYACTTG GTGTGGATGAGG'] | ['Hypermethioninemia with s-adenosylhomocysteine hydrolase deficiency'] |
| NM_000702.3 (ATP1A2):c.1033A>G (p.Thr345Ala) | 121918613 | ATP1A2 | [ ] | ['CTGYCAGGGTCA GGCACACCTGG'] | ['Familial hemiplegic migraine type 2'] |
| NM_003126.2 (SPTA1):c.143A>G (p.Lys48Arg) | 121918644 | SPTA1 | [ ] | [ ] | ['Hereditary pyropoikilocytosis'] |
| NM_001024858.2 (SPTB):c.1A>G (p.Met1Val) | 121918651 | SPTB | [ ] | [ ] | ['Elliptocytosis 3'] |
| NM_000899.4 (KITLG):c.107A>G (p.Asn36Ser) | 121918653 | KITLG | [ ] | [ ] | ['Familial progressive hyperpigmentation with or without hypopigmentation'] |
| NM_198253.2 (TERT):c.2315A>G (p.Tyr772Cys) | 121918663 | TERT | [ ] | [ ] | ['Aplastic anemia', 'PULMONARY FIBROSIS AND/OR BONE MARROW |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| | | | | | FAILURE, TELOMERE-RELATED, 1'] |
| NM_001063.3 (TF):c.1936A>G (p.Lys646Glu) | 121918678 | TF | [ ] | [ ] | [ ] |
| NM_000535.5 (PMS2):c.904-2A>G | 587781339 | PMS2 | [ ] | ['GCAGACCYGCA CAAAATACAAGG'] | ['Hereditary cancer-predisposing syndrome'] |
| NM_001128177.1 (THRB):c.1324A>G (p.Met442Val) | 121918691 | THRB | [ ] | ['CTTCAYGTGCAG GAAGCGGCTGG'] | ['Thyroid hormone resistance, generalized, autosomal dominant'] |
| NM_001128177.1 (THRB):c.1327A>G (p.Lys443Glu) | 121918692 | THRB | [ ] | ['CCACCTYCATGT GCAGGAAGCGG'] | ['Thyroid hormone resistance, generalized, autosomal dominant'] |
| NM_001128177.1 (THRB):c.1009A>G (p.Thr337Ala) | 121918709 | THRB | [ ] | [ ] | ['Thyroid hormone resistance, selective pituitary'] |
| NM_004612.3 (TGFBR1):c.1199A>G (p.Asp400Gly) | 121918711 | TGFBR1 | ['ATAGATG YCAGCACG TTTGAAGG'] | ['ATAGATGYCAG CACGTTTGAAGG'] | ['Loeys-Dietz syndrome 1'] |
| NM_000359.2 (TGM1):c.1469A>G (p.Asp490Gly) | 121918724 | TGM1 | [ ] | [ ] | ['Autosomal recessive congenital ichthyosis 1'] |
| NM_000257.3 (MYH7):c.1727A>G (p.His576Arg) | 727504238 | MYH7 | [ ] | [ ] | ['Familial hypertrophic cardiomyopathy 1', 'Cardiomyopathy', 'not specified'] |
| NM_000257.3 (MYH7):c.1954A>G (p.Arg652Gly) | 727504239 | MYH7 | [ ] | [ ] | ['Primary familial hypertrophic cardiomyopathy', 'Familial hypertrophic cardiomyopathy 1'] |
| NM_000257.3 (MYH7):c.1496A>G (p.Glu499Gly) | 727504270 | MYH7 | [ ] | [ ] | ['Cardiomyopathy', 'not specified'] |
| NM_000257.3 (MYH7):c.2539A>G (p.Lys847Glu) | 727504310 | MYH7 | [ ] | [ ] | ['Familial hypertrophic cardiomyopathy 1', 'Cardiomyopathy', 'not specified'] |
| NM_000256.3 (MYBPC3):c.2906-2A>G | 727504333 | MYBPC3 | [ ] | ['CCGTTCYGTGGG TATAGAGTGGG', 'GCCGTTCYGTGG GTATAGAGTGG'] | ['Familial hypertrophic cardiomyopathy 4'] |
| NM_001128425.1 (MUTYH):c.1187-2A>G | 587781628 | MUTYH | ['ACCYGAG AGGGAGG GCAGCCAG G'] | ['ACCYGAGAGGG AGGGCAGCCAGG'] | ['Hereditary cancer-predisposing syndrome', 'Carcinoma of colon'] |
| NM_005188.3 (CBL):c.1228-2A>G | 727504426 | CBL | [ ] | [ ] | ['Juvenile myelomonocytic leukemia', 'Noonan syndrome-like disorder with or without juvenile myelomonocytic leukemia', 'Rasopathy'] |
| NM_000501.3 (ELN):c.890-2A>G | 727504434 | ELN | ['GCCYGAA AACACAGC CACAGAGG'] | ['GCCYGAAAACA CAGCCACAGAGG'] | ['Supravalvar aortic stenosis'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001165963.1 (SCN1A):c.2877T>A (p.Cys959Ter) | 775214722 | SCN1A | [ ] | [ ] | ['not provided'] |
| NM_000833.4 (GRIN2A):c.2449A>G (p.Met817Val) | 796052551 | GRIN2A | ['CCAYGTT GTCAATGT CCAGCTGG'] | ['CCAYGTTGTCAA TGTCCAGCTGG'] | ['not provided'] |
| NM_000314.6 (PTEN):c.493-2A>G | 587781784 | PTEN | [ ] | [ ] | ['Hereditary cancer-predisposing syndrome'] |
| NM_000498.3 (CYP11B2):c.1157T>C (p.Val386Ala) | 61757294 | — | [ ] | [ ] | ['Corticosterone methyloxidase type 2 deficiency', 'Corticosterone methyloxidase type 1 deficiency'] |
| NM_006204.3 (PDE6C):c.1483-2A>G | 786200910 | PDE6C | [ ] | ['CTTTCYGTTGAA ATAAGGATGGG', 'TCTTTCYGTTGAA ATAAGGATGG'] | ['Achromatopsia 5'] |
| NM_003588.3 (CUL4B):c.901-2A>G | 786200913 | CUL4B | [ ] | [ ] | ['Syndromic X-linked mental retardation, Cabezas type'] |
| NM_000397.3 (CYBB):c.302A>G (p.His101Arg) | 137854591 | CYBB | [ ] | [ ] | ['Granulomatous disease, chronic, X-linked, variant', 'not provided'] |
| NM_000311.3 (PRNP):c.385A>G (p.Met129Val) | 1799990 | PRNP | [ ] | [ ] | ['Jakob-Creutzfeldt disease', 'Genetic prion diseases', 'Fatal familial insomnia', 'not specified'] |
| NM_000051.3 (ATM):c.3994-2A>G | 587782276 | ATM | [ ] | [ ] | ['Ataxia-telangiectasia syndrome', 'Hereditary cancer-predisposing syndrome'] |
| NM_005211.3 (CSF1R):c.1754-2A>G | 281860267 | CSF1R | [ ] | [ ] | ['Hereditary diffuse leukoencephalopathy with spheroids'] |
| NM_004646.3 (NPHS1):c.1756A>G (p.Arg586Gly) | 730880174 | NPHS1 | [ ] | [ ] | ['Finnish congenital nephrotic syndrome'] |
| NM_005211.3 (CSF1R):c.2320-2A>G | 281860272 | CSF1R | ['CACYGAG GGAAAGC ACTGCAGG G'] | ['CACYGAGGGAA AGCACTGCAGGG', 'GCACYGAGGGAA AGCACTGCAGG'] | ['Hereditary diffuse leukoencephalopathy with spheroids'] |
| NM_000256.3 (MYBPC3):c.3392T>C (p.Ile1131Thr) | 370890951 | MYBPC3 | [ ] | [ ] | ['Cardiomyopathy', 'Cardiac arrest', 'not specified'] |
| NM_000551.3 (VHL):c.586A>T (p.Lys196Ter) | 281860296 | VHL | [ ] | ['GGTCTTYCTGCA CATTTGGGTGG'] | ['Von Hippel-Lindau syndrome'] |
| NM_005247.2 (FGF3):c.146A>G (p.Tyr49Cys) | 281860300 | FGF3 | ['CAGYAGA GCTTGCGG CGCCGGGG', 'GCAGYAG AGCTTGCG GCGCCGGG', 'CGCAGYA GAGCTTGC GGCGCCGG'] | ['CAGYAGAGCTT GCGGCGCCGGGG', 'GCAGYAGAGCTT GCGGCGCCGGG', 'CGCAGYAGAGCT TGCGGCGCCGG'] | ['Deafness with labyrinthine aplasia microtia and microdontia (LAMM)'] |
| NM_005247.2 (FGF3):c.317A>G (p.Tyr106Cys) | 281860306 | FGF3 | [ ] | [ ] | ['Deafness with labyrinthine aplasia microtia and microdontia (LAMM)'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000314.6 (PTEN):c.403A>G (p.Ile135Val) | 587782360 | PTEN | [ ] | [ ] | ['Hereditary cancer-predisposing syndrome'] |
| NM_004990.3 (MARS):c.1031A>G (p.Tyr344Cys) | 766466297 | MARS | [ ] | [ ] | ['Pulmonary alveolar proteinosis', 'Interstitial lung and liver disease'] |
| NM_006343.2 (MERTK):c.1605-2A>G | 730880273 | MERTK | [ ] | [ ] | ['Retinitis pigmentosa 38'] |
| NM_003611.2 (OFD1):c.935+706A>G | 730880283 | OFD1 | [ ] | [ ] | ['Retinitis Pigmentosa 23'] |
| NM_004793.3 (LONP1):c.2353A>G (p.Arg785Gly) | 730880293 | LONP1 | [ ] | [ ] | ['CODAS syndrome'] |
| NM_001698.2 (AUH):c.263-2A>G | 730880311 | AUH | [ ] | [ ] | ['3-Methylglutaconic aciduria'] |
| NM_001698.2 (AUH):c.943-2A>G | 730880312 | AUH | [ ] | [ ] | ['3-Methylglutaconic aciduria'] |
| NM_000169.2 (GLA):c.370-2A>G | 730880444 | — | [ ] | ['GTGAACCYGAAATGAGAGGGAGG'] | ['not provided'] |
| NM_001110792.1 (MECP2):c.520A>G (p.Arg174Gly) | 727505391 | MECP2 | [ ] | [ ] | ['Rett disorder'] |
| NM_030662.3 (MAP2K2):c.181A>G (p.Lys61Glu) | 730880517 | MAP2K2 | [ ] | [ ] | ['Cardiofaciocutaneous syndrome', 'Rasopathy'] |
| NM_000256.3 (MYBPC3):c.1227-2A>G | 730880531 | MYBPC3 | [ ] | ['GTACCYGGGTGGGGGCCGCAGGG', 'TGTACCYGGGTGGGGGCCGCAGG'] | ['Familial hypertrophic cardiomyopathy 4', 'Cardiomyopathy'] |
| NM_000642.2 (AGL):c.4260-12A>G | 369973784 | AGL | [ ] | [ ] | ['Glycogen storage disease type III', 'Glycogen storage disease IIIa', 'Glycogen storage disease IIIb'] |
| NM_000267.3 (NF1):c.1642-8A>G | 267606602 | NF1 | [ ] | [ ] | ['Neurofibromatosis, type 1', 'Juvenile myelomonocytic leukemia'] |
| NM_000267.3 (NF1):c.5944-5A>G | 267606604 | NF1 | [ ] | [ ] | ['Neurofibromatosis, type 1', 'Neurofibromatosis, familial spinal'] |
| m.1555A>G | 267606617 | MT-RNR1 | [ ] | [ ] | ['Aminoglycoside-induced deafness', 'Cardiomyopathy, restrictive', 'Deafness, nonsyndromic sensorineural, mitochondrial'] |
| NM_022458.3 (LMBR1):c.423+5252A>G | 606231150 | LMBR1 | [ ] | [ ] | ['Triphalangeal thumb', 'Preaxial polydactyly 2'] |
| NM_000642.2 (AGL):c.3439A>G (p.Arg1147Gly) | 267606639 | AGL | [ ] | [ ] | ['Glycogen storage disease IIIc'] |
| NM_013411.4 (AK2):c.494A>G (p.Asp165Gly) | 267606643 | AK2 | [ ] | ['TCAYCTTTCATGGGCTCTTTTGG'] | ['Reticular dysgenesis'] |
| NM_001142800.1 (EYS):c.9209T>C (p.Ile3070Thr) | 183589498 | EYS | [ ] | [ ] | ['Retinitis pigmentosa'] |
| NM_004183.3 (BEST1):c.680A>G (p.Tyr227Cys) | 267606677 | BEST1 | [ ] | [ ] | ['Vitelliform dystrophy', 'Retinitis pigmentosa, concentric', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_005188.3 (CBL):c.1144A>G (p.Lys382Glu) | 267606705 | CBL | [ ] | ['TATTTYACATAG TTGGAATGTGG'] | ['Noonan syndrome-like disorder with or without juvenile myelomonocytic leukemia'] |
| NM_001017361.2 (KHDC3L):c.1A>G (p.Met1Val) | 606231235 | KHDC3L | [ ] | [ ] | ['Hydatidiform mole, recurrent, 2'] |
| NM_144577.3 (CCDC114):c.487-2A>G | 606231239 | CCDC114 | [ ] | [ ] | ['Ciliary dyskinesia, primary, 20'] |
| NM_000277.1 (PAH):c.916A>G (p.Ile306Val) | 62642934 | PAH | [ ] | ['GGCCAAYTTCCT GTAATTGGGGG', 'AGGCCAAYTTCC TGTAATTGGGG'] | ['Phenylketonuria', 'Hyperphenylalaninemia, non-pku', 'not provided'] |
| NM_000257.3 (MYH7):c.2792A>G (p.Glu931Gly) | 730880760 | MYH7 | [ ] | [ ] | ['Cardiomyopathy'] |
| NM_207034.2 (EDN3):c.335A>G (p.His112Arg) | 267606778 | EDN3 | [ ] | [ ] | ['Waardenburg syndrome type 4B'] |
| NM_000117.2 (EMD):c.1A>G (p.Met1Val) | 267606782 | EMD | [ ] | ['TCCAYGGCGGGT GCGGGCTCAGG'] | ['Emery-Dreifuss muscular dystrophy, X-linked'] |
| NM_003937.2 (KYNU):c.592A>G (p.Thr198Ala) | 606231307 | KYNU | [ ] | [ ] | ['Hydroxykynureninuria'] |
| NM_004387.3 (NKX2-5):c.461A>G (p.Glu154Gly) | 587782928 | NKX2-5 | [ ] | [ ] | ['Atrial septal defect 7 with or without atrioventricular conduction defects'] |
| NM_000142.4 (FGFR3):c.1454A>G (p.Gln485Arg) | 267606808 | FGFR3 | [ ] | [ ] | ['Thanatophoric dysplasia type 1'] |
| NM_014053.3 (FLVCR1):c.361A>G (p.Asn121Asp) | 267606820 | FLVCR1 | [ ] | ['AGGCGTYGACC AGCGAGTACAGG'] | ['Posterior column ataxia with retinitis pigmentosa'] |
| NM_000257.3 (MYH7):c.4664A>G (p.Glu1555Gly) | 730880805 | — | [ ] | ['GCCCYCCTCGTG CTCCAGGGAGG', 'CTTGCCCYCCTC GTGCTCCAGGG'] | ['Cardiomyopathy'] |
| NM_138387.3 (G6PC3):c.346A>G (p.Met116Val) | 267606834 | G6PC3 | [ ] | ['TGATCAYGCAGT GTCCAGAAGGG', 'GTGATCAYGCAG TGTCCAGAAGG'] | ['Dursun syndrome'] |
| NM_020347.3 (LZTFL1):c.260T>C (p.Leu87Pro) | 515726135 | LZTFL1 | [ ] | [ ] | ['Bardet-Biedl syndrome', 'Bardet-Biedl syndrome 17'] |
| NM_000175.3 (GPI):c.1028A>G (p.Gln343Arg) | 267606851 | GPI | [ ] | ['GTACYGGTCATA GGGCAGCATGG'] | ['Hemolytic anemia, nonspherocytic, due to glucose phosphate isomerase deficiency'] |
| NM_005859.4 (PURA):c.289A>G (p.Lys97Glu) | 587782994 | PURA | [ ] | [ ] | ['Neonatal hypotonia', 'Intellectual disability', 'Seizures', 'Delayed speech and language development', 'Global developmental delay', 'Mental retardation, autosomal dominant 31'] |
| NM_005144.4 (HR):c.-218A>G | 267606869 | HR | ['CTCYAGG GCCGCAGG TTGGAGGG'] | ['CTCYAGGGCCGC AGGTTGGAGGG', 'GCTCYAGGGCCG CAGGTTGGAGG', | ['Marie Unna hereditary hypotrichosis 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000257.3 (MYH7):c.789A>G (p.Ile263Met) | 730880855 | MYH7 | [ ] | 'GGCGCTCYAGGG CCGCAGGTTGG'] | ['Cardiomyopathy'] |
| NM_000060.3 (BTD):c.683A>G (p.Asp228Gly) | 587783004 | BTD | [ ] | [ ] | ['Biotinidase deficiency'] |
| NM_000257.3 (MYH7):c.1051A>G (p.Lys351Glu) | 730880864 | MYH7 | [ ] | [ ] | ['Cardiomyopathy'] |
| NM_015713.4 (RRM2B):c.190T>C (p.Trp64Arg) | 515726182 | RRM2B | [ ] | ['TTCCTTCYGGAC AGCAGAAGAGG'] | ['RRM2B-related mitochondrial disease'] |
| NM_005957.4 (MTHFR):c.971A>G (p.Asn324Ser) | 267606887 | MTHFR | ['CGCGGYT GAGGGTGT AGAAGTGG'] | ['CGCGGYTGAGG GTGTAGAAGTGG'] | ['Homocystinuria due to MTHFR deficiency'] |
| NM_015713.4 (RRM2B):c.368T>C (p.Phe123Ser) | 515726187 | RRM2B | [ ] | [ ] | ['RRM2B-related mitochondrial disease'] |
| m.12770A>G | 267606894 | MT-ND5 | [ ] | [ ] | ['Juvenile myopathy, encephalopathy, lactic acidosis AND stroke'] |
| NM_000257.3 (MYH7):c.1805A>G (p.Asn602Ser) | 730880880 | MYH7 | [ ] | [ ] | ['Cardiomyopathy'] |
| NM_018109.3 (MTPAP):c.1432A>G (p.Asn478Asp) | 267606900 | MTPAP | ['AATGGAT YCTGAATG TACAGAGG'] | ['AATGGATYCTGA ATGTACAGAGG'] | ['Ataxia, spastic, 4, autosomal recessive'] |
| NM_000257.3 (MYH7):c.2717A>G (p.Asp906Gly) | 267606908 | MYH7 | [ ] | [ ] | ['Primary familial hypertrophic cardiomyopathy', 'Familial hypertrophic cardiomyopathy 1', 'Cardiomyopathy'] |
| NM_003122.4 (SPINK1):c.160T>C (p.Tyr54His) | 515726207 | SPINK1 | [ ] | [ ] | ['Hereditary pancreatitis'] |
| NM_003159.2 (CDKL5):c.404-2A>G | 587783080 | CDKL5 | [ ] | [ ] | ['not provided'] |
| NM_003159.2 (CDKL5):c.449A>G (p.Lys150Arg) | 587783083 | CDKL5 | ['ACAGTYT TAGGACAT CATTGTGG'] | ['ACAGTYTTAGGA CATCATTGTGG'] | ['not provided'] |
| NM_016203.3 (PRKAG2):c.1589A>G (p.His530Arg) | 267606977 | PRKAG2 | [ ] | [ ] | ['Familial hypertrophic cardiomyopathy 6', 'not provided'] |
| NM_198965.1 (PTHLH):c.534A>G (p.Ter178Trp) | 267606987 | PTHLH | [ ] | [ ] | ['Brachydactyly type E2'] |
| NM_000531.5 (OTC):c.122A>G (p.Asp41Gly) | 74518351 | OTC | [ ] | [ ] | ['not provided'] |
| NM_001134363.2 (RBM20):c.1909A>G (p.Ser637Gly) | 267607005 | RBM20 | [ ] | [ ] | ['Dilated cardiomyopathy 1DD'] |
| NM_000553.4 (WRN):c.403A>G (p.Lys135Glu) | 267607008 | WRN | [ ] | [ ] | ['Werner syndrome'] |
| NM_002880.3 (RAF1):c.1279A>G (p.Ser427Gly) | 730881002 | RAF1 | [ ] | ['GCTGCYGCCCTC GCACCACTGGG', 'GGCTGCYGCCCT CGCACCACTGG'] | ['Rasopathy'] |
| NM_002977.3 (SCN9A):c.29A>G (p.Gln10Arg) | 267607030 | SCN9A | [ ] | ['AAGCTCYGAGG TCCTGGGGGAGG'] | ['Primary erythromelalgia'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_016955.3 (SEPSECS):c.1001A>G (p.Tyr334Cys) | 267607036 | SEPSECS | [ ] | [ ] | ['Pontocerebellar hypoplasia type 2D'] |
| NM_007373.3 (SHOC2):c.4A>G (p.Ser2Gly) | 267607048 | SHOC2 | [ ] | ['TACYCATGGTGA CTCAAGCCTGG'] | ['Noonan-like syndrome with loose anagen hair', 'Rasopathy'] |
| NM_005633.3 (SOS1):c.1430A>G (p.Gln477Arg) | 730881044 | SOS1 | [ ] | [ ] | ['Rasopathy'] |
| NM_007375.3 (TARDBP):c.787A>G (p.Lys263Glu) | 267607102 | TARDBP | [ ] | [ ] | ['FRONTOTEMPORAL DEMENTIA WITH TDP43 INCLUSIONS, TARDBP-RELATED'] |
| NM_003286.2 (TOP1):c.1598A>G (p.Asp533Gly) | 267607131 | — | [ ] | [ ] | [ ] |
| NM_021625.4 (TRPV4):c.1805A>G (p.Tyr602Cys) | 267607150 | TRPV4 | [ ] | [ ] | ['Spondyloepiphyseal dysplasia Maroteaux type'] |
| NM_000551.3 (VHL):c.491A>G (p.Gln164Arg) | 267607170 | VHL | [ ] | [ ] | ['Von Hippel-Lindau syndrome'] |
| NM_001006657.1 (WDR35):c.1877A>G (p.Glu626Gly) | 267607174 | WDR35 | [ ] | [ ] | ['Cranioectodermal dysplasia 2'] |
| NM_024884.2 (L2HGDH):c.293A>G (p.His98Arg) | 267607206 | L2HGDH | [ ] | [ ] | ['L-2-hydroxyglutaric aciduria'] |
| NM_002437.4 (MPV17):c.262A>G (p.Lys88Glu) | 267607256 | MPV17 | [ ] | [ ] | ['Navajo neurohepatopathy'] |
| NM_006888.4 (CALM1):c.293A>G (p.Asn98Ser) | 267607277 | CALM1 | [ ] | [ ] | ['Catecholaminergic polymorphic ventricular tachycardia', 'Ventricular tachycardia, catecholaminergic polymorphic, 4'] |
| NM_000487.5 (ARSA):c.*96A>G | 6151429 | ARSA | [ ] | [ ] | ['Metachromatic leukodystrophy', 'Arylsulfatase A pseudodeficiency', 'not provided'] |
| NM_003122.4 (SPINK1):c.194+2T>C | 148954387 | SPINK1 | [ ] | [ ] | ['Hereditary pancreatitis'] |
| NM_000552.3 (VWF):c.3437A>G (p.Tyr1146Cys) | 267607326 | VWF | [ ] | [ ] | ['von Willebrand disease type 2', 'not provided'] |
| NM_000489.4 (ATRX):c.4826A>G (p.His1609Arg) | 122445093 | ATRX | [ ] | [ ] | ['ATR-X syndrome'] |
| NM_000489.4 (ATRX):c.6488A>G (p.Tyr2163Cys) | 122445098 | ATRX | [ ] | [ ] | ['ATR-X syndrome'] |
| NM_000489.4 (ATRX):c.6811A>G (p.Arg2271Gly) | 122445112 | ATRX | [ ] | [ ] | [ ] |
| NM_004380.2 (CREBBP):c.3983-2A>G | 587783486 | CREBBP | [ ] | ['GCAGCCCYAGG AAGTCCAGAAGG'] | ['Rubinstein-Taybi syndrome'] |
| NM_004380.2 (CREBBP):c.4508A>G (p.Tyr1503Cys) | 587783497 | CREBBP | [ ] | [ ] | ['Rubinstein-Taybi syndrome'] |
| NM_000051.3 (ATM):c.3154-2A>G | 730881357 | ATM | [ ] | ['AGCCYACGGGA AAAGAACTGTGG'] | ['Hereditary cancer-predisposing syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_178151.2 (DCX):c.1027-2A>G | 587783518 | DCX | [ ] | [ ] | ['Heterotopia'] |
| NM_178151.2 (DCX):c.520A>G (p.Lys174Glu) | 587783557 | DCX | [ ] | [ ] | ['Heterotopia'] |
| NM_178151.2 (DCX):c.538A>G (p.Lys180Glu) | 587783560 | DCX | [ ] | [ ] | ['Heterotopia'] |
| NM_178151.2 (DCX):c.607A>G (p.Thr203Ala) | 587783570 | DCX | [ ] | [ ] | ['Heterotopia'] |
| NM_001257235.1 (ALG13):c.8A>G (p.Asn3Ser) | 398122394 | ALG13 | [ ] | [ ] | ['Congenital disorder of glycosylation type 1s'] |
| NM_001256864.1 (DNAJC6):c.801-2A>G | 398122404 | DNAJC6 | [ ] | ['AGGTATCYGAA ACAGAAGGTTGG'] | ['Parkinson disease 19, juvenile-onset'] |
| NM_001927.3 (DES):c.1024A>G (p.Asn342Asp) | 267607482 | DES | [ ] | ['GAATCGTYCTGC AGGAGAGGGGG'] | ['Myofibrillar myopathy 1', 'not provided'] |
| NM_001927.3 (DES):c.735+3A>G | 267607483 | DES | [ ] | [ ] | ['Myofibrillar myopathy 1', 'not provided'] |
| NM_001927.3 (DES):c.1333A>G (p.Thr445Ala) | 267607498 | DES | [ ] | [ ] | ['not provided'] |
| NM_005249.4 (FOXG1):c.757A>G (p.Asn253Asp) | 587783641 | FOXG1 | [ ] | [ ] | ['Rett syndrome, congenital variant'] |
| NM_000252.2 (MTM1):c.1406A>G (p.His469Arg) | 587783789 | MTM1 | [ ] | [ ] | ['Severe X-linked myotubular myopathy'] |
| NM_000391.3 (TPP1):c.833A>G (p.Gln278Arg) | 796053439 | TPP1 | [ ] | ['CAGGTACYGCA CATCTAGACTGG'] | ['not provided'] |
| NM_000252.2 (MTM1):c.301A>G (p.Ser101Gly) | 587783818 | MTM1 | [ ] | [ ] | ['Severe X-linked myotubular myopathy'] |
| NM_000252.2 (MTM1):c.343-2A>G | 587783821 | MTM1 | [ ] | [ ] | ['Severe X-linked myotubular myopathy'] |
| NM_000252.2 (MTM1):c.529-2A>G | 587783831 | MTM1 | [ ] | [ ] | ['Severe X-linked myotubular myopathy'] |
| NM_000252.2 (MTM1):c.550A>G (p.Arg184Gly) | 587783835 | MTM1 | [ ] | ['GTTATTCYCCAA TGGTGATTGGG'] | ['Severe X-linked myotubular myopathy'] |
| NM_000158.3 (GBE1):c.691+2T>C | 192044702 | GBE1 | [ ] | [ ] | ['Glycogen storage disease, type IV'] |
| NM_000252.2 (MTM1):c.629A>G (p.Asp210Gly) | 587783842 | MTM1 | [ ] | ['TCATCAYCTGAG GCACGATACGG'] | ['Severe X-linked myotubular myopathy'] |
| NM_000249.3 (MLH1):c.545+3A>G | 267607760 | MLH1 | [ ] | [ ] | ['Hereditary Nonpolyposis Colorectal Neoplasms'] |
| NM_000249.3 (MLH1):c.589-2A>G | 267607767 | MLH1 | [ ] | [ ] | ['Hereditary Nonpolyposis Colorectal Neoplasms', 'Hereditary cancer-predisposing syndrome'] |
| NM_000249.3 (MLH1):c.884+4A>G | 267607777 | MLH1 | [ ] | ['TGCTACAYTACC TGAGGTACAGG'] | ['Hereditary Nonpolyposis Colorectal Neoplasms'] |
| NM_000081.3 (LYST):c.10127A>G (p.Asn3376Ser) | 80338669 | LYST | [ ] | [ ] | ['Ch\xc3\xa9diak-Higashi syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000528.3 (MAN2B1):c.1831-2A>G | 80338678 | MAN2B1 | [ ] | [ ] | ['Deficiency of alpha-mannosidase'] |
| NM_022132.4 (MCCC2):c.569A>G (p.His190Arg) | 119103225 | MCCC2 | [ ] | [ ] | ['3-methylcrotonyl CoA carboxylase 2 deficiency'] |
| m.3260A>G | 199474663 | MT-TL1 | ['TTAAGTT YTATGCGA TTACCGGG'] | ['TTAAGTTYTATG CGATTACCGGG'] | ['Cardiomyopathy with or without skeletal myopathy'] |
| NM_014874.3 (MFN2):c.827A>G (p.Gln276Arg) | 119103264 | MFN2 | [ ] | [ ] | ['Hereditary motor and sensory neuropathy with optic atrophy'] |
| NM_004525.2 (LRP2):c.770-2A>G | 80338743 | LRP2 | [ ] | [ ] | ['Donnai Barrow syndrome'] |
| NM_005120.2 (MED12):c.3020A>G (p.Asn1007Ser) | 80338759 | MED12 | [ ] | [ ] | ['X-linked mental retardation with marfanoid habitus syndrome'] |
| NM_000834.3 (GRIN2B):c.2172-2A>G | 398122824 | GRIN2B | [ ] | [ ] | ['Mental retardation, autosomal dominant 6'] |
| NM_000249.3 (MLH1):c.1990-2A>G | 267607883 | MLH1 | [ ] | [ ] | ['Hereditary Nonpolyposis Colorectal Neoplasms', 'not provided'] |
| NM_000518.4 (HBB):c.59A>G (p.Asn20Ser) | 33972047 | HBB | [ ] | ['CACGYTCACCTT GCCCCACAGGG', 'CCACGYTCACCT TGCCCCACAGG'] | ['alpha Thalassemia'] |
| NM_003688.3 (CASK):c.2168A>G (p.Tyr723Cys) | 398122844 | CASK | [ ] | [ ] | ['FG syndrome 4', 'Mental retardation and microcephaly with pontine and cerebellar hypoplasia'] |
| NM_024675.3 (PALB2):c.109-2A>G | 730881897 | PALB2 | [ ] | [ ] | ['Hereditary cancer-predisposing syndrome'] |
| NM_000251.2 (MSH2):c.1511-2A>G | 267607962 | MSH2 | [ ] | [ ] | ['Hereditary Nonpolyposis Colorectal Neoplasms'] |
| NM_003124.4 (SPR):c.596-2A>G | 398122922 | SPR | [ ] | [ ] | [Sepiapterin reductase deficiency'] |
| NM_022455.4 (NSD1):c.4498-3A>G | 587784120 | NSD1 | [ ] | [ ] | ['Sotos syndrome 1'] |
| NM_000455.4 (STK11):c.889A>G (p.Arg297Gly) | 730881978 | STK11 | [ ] | [ ] | ['Hereditary cancer-predisposing syndrome'] |
| NM_001927.3 (DES):c.1289-2A>G | 398122940 | DES | [ ] | [ ] | ['Muscular dystrophy, limb-girdle, type 2r'] |
| NM_000546.5 (TP53):c.709A>G (p.Met237Val) | 730882004 | TP53 | [ ] | ['ACACAYGTAGTT GTAGTGGATGG'] | ['Li-Fraumeni syndrome', 'Hereditary cancer-predisposing syndrome'] |
| NM_024876.3 (ADCK4):c.857A>G (p.Asp286Gly) | 398122979 | ADCK4 | [ ] | [ ] | ['Nephrotic syndrome, type 9'] |
| NM_022455.4 (NSD1):c.6059A>G (p.Asn2020Ser) | 587784178 | NSD1 | [ ] | [ ] | ['Sotos syndrome 1'] |
| NM_022455.4 (NSD1):c.6356A>G (p.Asp2119Gly) | 587784191 | NSD1 | [ ] | [ ] | ['Sotos syndrome 1'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_007332.2 (TRPA1):c.2564A>G (p.Asn855Ser) | 398123010 | — | [ ] | [ ] | ['Familial episodic pain syndrome 1'] |
| NM_001231.4 (CASQ1):c.731A>G (p.Asp244Gly) | 730882052 | CASQ1 | [ ] | ['GGCTTGYCTGGG ATGGTCACAGG'] | ['Myopathy, vacuolar, with casq1 aggregates'] |
| NM_004004.5 (GJB2):c.487A>G (p.Met163Val) | 80338949 | GJB2 | [ ] | [ ] | ['Deafness, autosomal recessive 1A', 'not specified'] |
| NM_130466.3 (UBE3B):c.545-2A>G | 398123022 | UBE3B | [ ] | [ ] | ['Kaufman oculocerebrofacial syndrome'] |
| NM_000334.4 (SCN4A):c.4078A>G (p.Met1360Val) | 80338959 | SCN4A | [ ] | ['GATCAYGATGGT GATGTCGAAGG'] | ['Hyperkalemic Periodic Paralysis Type 1'] |
| NM_000334.4 (SCN4A):c.4108A>G (p.Met1370Val) | 80338960 | SCN4A | [ ] | ['CCATCAYGGTGA CCATGTTGAGG'] | ['Hyperkalemic Periodic Paralysis Type 1'] |
| NM_000334.4 (SCN4A):c.4774A>G (p.Met1592Val) | 80338962 | SCN4A | [ ] | ['TGTACAYGTTGA CCACGATGAGG'] | ['Hyperkalemic Periodic Paralysis Type 1', 'Familial hyperkalemic periodic paralysis'] |
| NM_015250.3 (BICD2):c.2321A>G (p.Glu774Gly) | 398123030 | BICD2 | [ ] | [ ] | ['Spinal muscular atrophy, lower extremity predominant 2, autosomal dominant'] |
| NM_006012.2 (CLPP):c.270+4A>G | 398123035 | CLPP | [ ] | [ ] | ['Autosomal recessive hearing impairment with normal menstrual cycles'] |
| NM_000179.2 (MSH6):c.3439-2A>G | 267608098 | MSH6 | [ ] | [ ] | ['Hereditary Nonpolyposis Colorectal Neoplasms', 'Hereditary cancer-predisposing syndrome', 'not provided'] |
| NM_002246.2 (KCNK3):c.575A>G (p.Tyr192Cys) | 398123043 | KCNK3 | [ ] | [ ] | ['Primary pulmonary hypertension 4'] |
| NM_001070.4 (TUBG1):c.275A>G (p.Tyr92Cys) | 398123046 | TUBG1 | [ ] | [ ] | ['Cortical dysplasia, complex, with other brain malformations 4'] |
| NM_000383.3 (AIRE):c.254A>G (p.Tyr85Cys) | 179363882 | AIRE | [ ] | [ ] | ['Polyglandular autoimmune syndrome, type 1', 'not provided'] |
| NM_001651.3 (AQP5):c.367A>G (p.Asn123Asp) | 398123057 | AQP5 | [ ] | [ ] | ['Diffuse palmoplantar keratoderma, Bothnian type'] |
| NM_012160.4 (FBXL4):c.1694A>G (p.Asp565Gly) | 398123062 | FBXL4 | [ ] | ['TATGYCCAGCTG CTGTAACCTGG'] | ['Mitochondrial DNA depletion syndrome 13 (encephalomyopathic type)'] |
| NM_024531.4 (SLC52A2):c.914A>G (p.Tyr305Cys) | 398123068 | SLC52A2 | [ ] | [ ] | [Brown-Vialetto-Van Laere syndrome 2'] |
| NM_001039550.1 (DNAJB2):c.14A>G (p.Tyr5Cys) | 730882140 | DNAJB2 | [ ] | ['GATCTCGYAGTA GGATGCCATGG'] | ['Charcot-Marie-Tooth disease', 'Charcot-Marie-Tooth disease, axonal, type 2T'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_052859.3 (RFT1):c.1222A>G (p.Met408Val) | 796053522 | RFT1 | [ ] | ['GCAYCACAAAA TTGTACCTGGGG', 'AGCAYCACAAAA TTGTACCTGGG', 'CAGCAYCACAAA ATTGTACCTGG'] | ['Congenital disorder of glycosylation type 1N'] |
| NM_007294.3 (BRCA1):c.5057A>G (p.His1686Arg) | 730882166 | BRCA1 | [ ] | [ ] | ['Breast-ovarian cancer, familial 1'] |
| NM_000050.4 (ASS1):c.496-2A>G | 398123130 | ASS1 | [ ] | [ ] | ['Citrullinemia type I'] |
| NM_012233.2 (RAB3GAP1):c.649-2A>G | 730882183 | RAB3GAP1 | [ ] | [ ] | ['Warburg micro syndrome 1'] |
| NM_000159.3 (GCDH):c.542A>G (p.Glu181Gly) | 398123194 | GCDH | [ ] | [ ] | ['Glutaric aciduria, type 1', 'not provided'] |
| NM_000288.3 (PEX7):c.340-10A>G | 267608255 | PEX7 | [ ] | [ ] | ['Phytanic acid storage disease', 'Peroxisome biogenesis disorder 9B'] |
| NM_000038.5 (APC):c.221-2A>G | 786201291 | APC | [ ] | [ ] | ['Hereditary cancer-predisposing syndrome'] |
| NM_000169.2 (GLA):c.509A>G (p.Asp170Gly) | 398123210 | — | [ ] | [ ] | ['Fabry disease'] |
| NM_000169.2 (GLA):c.548-2A>G | 398123211 | — | [ ] | ['AACCYGTATGA GAAAACAATGGG', 'TAACCYGTATGA GAAAACAATGG'] | ['Fabry disease'] |
| NM_006888.4 (CALM1):c.389A>G (p.Asp130Gly) | 730882252 | CALM1 | [ ] | [ ] | ['Long QT syndrome 14'] |
| NM_000169.2 (GLA):c.647A>G (p.Tyr216Cys) | 398123217 | — | [ ] | [ ] | ['Fabry disease'] |
| NM_006306.3 (SMC1A):c.616-2A>G | 587784423 | SMC1A | [ ] | ['AGCCYGTGCAA ACAGGGGAATGG'] | ['Congenital muscular hypertrophy-cerebral syndrome'] |
| NM_000255.3 (MUT):c.1445-2A>G | 398123276 | MUT | [ ] | [ ] | ['Methylmalonic aciduria due to methylmalonyl-CoA mutase deficiency', 'not provided'] |
| NM_001083962.1 (TCF4):c.991-2A>G | 587784470 | TCF4 | [ ] | [ ] | ['Pitt-Hopkins syndrome'] |
| NM_000060.3 (BTD):c.1205A>G (p.Asn402Ser) | 201023772 | BTD | [ ] | [ ] | ['Biotinidase deficiency'] |
| NC_000007.14: g.62535490A>G | 483352872 | — | [ ] | [ ] | ['Isolated growth hormone deficiency type 1B'] |
| NM_000271.4 (NPC1):c.1832A>G (p.Asp611Gly) | 483352887 | NPC1 | [ ] | [ ] | ['Niemann-Pick disease type C1'] |
| NM_152419.2 (HGSNAT):c.372-2A>G | 483352896 | HGSNAT | [ ] | [ ] | ['Mucopolysaccharidosis, MPS-III-C'] |
| NM_001199397.1 (NEK1):c.869-2A>G | 483352906 | NEK1 | [ ] | [ ] | ['Short rib-polydactyly syndrome, Majewski type'] |
| NM_000350.2 (ABCA4):c.67-2A>G | 398123339 | ABCA4 | [ ] | [ ] | ['Stargardt disease 1'] |
| NM_004992.3 (MECP2):c.27-2A>G | 267608412 | MECP2 | [ ] | [ ] | ['Rett disorder', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_003159.2 (CDKL5):c.100-2A>G | 267608423 | CDKL5 | [ ] | [ ] | ['Early infantile epileptic encephalopathy 2', 'not provided'] |
| NM_003159.2 (CDKL5):c.125A>G (p.Lys42Arg) | 267608429 | CDKL5 | [ ] | [ ] | ['Early infantile epileptic encephalopathy 2', 'not provided'] |
| NM_000487.5 (ARSA):c.1108-2A>G | 398123411 | ARSA | [ ] | ['GGCTCYGGGGG CAGAGTCAGGGG', 'GGGCTCYGGGGG CAGAGTCAGGG', 'AGGGCTCYGGGG GCAGAGTCAGG'] | ['Metachromatic leukodystrophy'] |
| NM_003159.2 (CDKL5):c.380A>G (p.His127Arg) | 267608468 | CDKL5 | [ ] | [ ] | ['Atypical Rett syndrome', 'not provided'] |
| NM_000489.4 (ATRX):c.134-2A>G | 398123420 | ATRX | [ ] | [ ] | ['not provided'] |
| NM_003159.2 (CDKL5):c.464-2A>G | 267608480 | CDKL5 | [ ] | [ ] | ['Early infantile epileptic encephalopathy 2', 'not provided'] |
| NM_000489.4 (ATRX):c.536A>G (p.Asn179Ser) | 398123425 | ATRX | [ ] | [ ] | ['not provided'] |
| NM_000512.4 (GALNS):c.1171A>G (p.Met391Val) | 398123429 | GALNS | [ ] | ['CCGCCAYCAGC GTGTCGCCACGG'] | ['Mucopolysaccharidosis, MPS-IV-A', 'not provided'] |
| NM_003159.2 (CDKL5):c.578A>G (p.Asp193Gly) | 267608500 | CDKL5 | [ ] | ['ATGYCCACGGA CTTTCCATAGGG', 'CATGYCCACGGA CTTTCCATAGG'] | ['Early infantile epileptic encephalopathy 2'] |
| NM_000521.3 (HEXB):c.1243-2A>G | 398123446 | HEXB | [ ] | [ ] | ['Sandhoff disease', 'not provided'] |
| NM_003159.2 (CDKL5):c.978-2A>G | 267608553 | CDKL5 | [ ] | [ ] | ['Early infantile epileptic encephalopathy 2', 'not provided'] |
| NM_001164342.2 (ZBTB20):c.1787A>G (p.His596Arg) | 483353066 | ZBTB20 | [ ] | [ ] | ['Primrose syndrome'] |
| NM_000402.4 (G6PD):c.188T>C (p.Ile63Thr) | 398123552 | — | [ ] | ['ACACACAYATTC ATCATCATGGG'] | ['Anemia, nonspherocytic hemolytic, due to G6PD deficiency', 'not provided'] |
| NM_001893.4 (CSNK1D):c.130A>G (p.Thr44Ala) | 104894561 | CSNK1D | [ ] | [ ] | ['Advanced sleep phase syndrome, familial, 2'] |
| NM_000155.3 (GALT):c.563A>G (p.Gln188Arg) | 75391579 | GALT | [ ] | ['TTACCYGGCAGT GGGGGTGGGGG', 'CTTACCYGGCAG TGGGGGTGGGG', 'CCTTACCYGGCA GTGGGGGTGGG'] | ['Deficiency of UDPglucose-hexose-1-phosphate uridylyltransferase', 'not provided'] |
| NM_007055.3 (POLR3A):c.2554A>G (p.Met852Val) | 267608671 | POLR3A | [ ] | [ ] | ['Hypomyelinating leukodystrophy 7'] |
| NM_001848.2 (COL6A1):c.805-2A>G | 398123639 | COL6A1 | [ ] | ['TTCTCCCYGGAA CACAAAACAGG'] | ['Ullrich congenital muscular dystrophy', 'Bethlem myopathy', 'not provided'] |
| NM_001918.3 (DBT):c.773-2A>G | 398123674 | DBT | [ ] | [ ] | ['Maple syrup urine disease', 'not provided'] |
| NM_001999.3 (FBN2):c.3740T>C (p.Met1247Thr) | 149054177 | FBN2 | ['GAATGTA YGATAATG AACGGAG G'] | ['GAATGTAYGAT AATGAACGGAGG'] | ['not specified', 'Macular degeneration, early-onset'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_003482.3 (KMT2D):c.5645-2A>G | 398123750 | KMT2D | [ ] | ['GCAGTTCYGTGG GGGAATGAAGG'] | ['Kabuki make-up syndrome', 'not provided'] |
| NM_003494.3 (DYSF):c.1398-2A>G | 398123769 | DYSF | [ ] | [ ] | ['Limb-girdle muscular dystrophy, type 2B', 'not provided'] |
| NM_015560.2 (OPA1):c.1146A>G (p.Ile382Met) | 143319805 | OPA1 | [ ] | [ ] | ['Dominant hereditary optic atrophy', 'Optic Atrophy Type 1', 'not specified', 'not provided'] |
| NM_203447.3 (DOCK8):c.1418A>G (p.Lys473Arg) | 112321280 | DOCK8 | [ ] | [ ] | ['Hyperimmunoglobulin E recurrent infection syndrome, autosomal recessive'] |
| NM_001145.4 (ANG):c.121A>G (p.Lys41Glu) | 121909537 | — | ['TGGTTYG GCATCATA GTGCTGGG, 'GTGGTTYG GCATCATA GTGCTGG'] | ['TGGTTYGGCATC ATAGTGCTGGG', 'GTGGTTYGGCAT CATAGTGCTGG'] | ['Amyotrophic lateral sclerosis type 9'] |
| NM_004006.2 (DMD):c.3432+3A>G | 398123938 | DMD | [ ] | [ ] | ['Dilated cardiomyopathy 3B'] |
| NM_006514.3 (SCN10A):c.1661T>C (p.Leu554Pro) | 138404783 | SCN10A | [ ] | [ ] | ['Episodic pain syndrome, familial, 2'] |
| NM_004006.2 (DMD):c.6763-2A>G | 398124033 | DMD | [ ] | [ ] | ['Dilated cardiomyopathy 3B'] |
| NM_001079802.1 (FKTN):c.1112A>G (p.Tyr371Cys) | 119464998 | FKTN | [ ] | [ ] | [ ] |
| NM_004006.2 (DMD):c.9224+61934A>G | 398124084 | DMD | [ ] | [ ] | ['Dilated cardiomyopathy 3B'] |
| NM_004006.2 (DMD):c.9225-647A>G | 398124091 | DMD | [ ] | [ ] | ['Duchenne muscular dystrophy', 'Becker muscular dystrophy', 'Dilated cardiomyopathy 3B'] |
| NM_004006.2 (DMD):c.9650-2A>G | 398124100 | DMD | [ ] | [ ] | ['Duchenne muscular dystrophy', 'Becker muscular dystrophy', 'Dilated cardiomyopathy 3B'] |
| NM_198578.3 (LRRK2):c.3342A>G (p.Leu1114=) | 35808389 | LRRK2 | [ ] | [ ] | ['Parkinson disease 8, autosomal dominant'] |
| NM_031229.2 (RBCK1):c.1160A>G (p.Asn387Ser) | 566912235 | RBCK1 | [ ] | [ ] | ['Polyglucosan body myopathy 1 with or without immunodeficiency'] |
| NM_000178.2 (GSS):c.656A>G (p.Asp219Gly) | 28938472 | GSS | [ ] | [ ] | ['Glutathione synthetase deficiency of erythrocytes, hemolytic anemia due to'] |
| NM_025132.3 (WDR19):c.407-2A>G | 374400438 | WDR19 | [ ] | [ ] | [SENIOR-LOKEN SYNDROME 8'] |
| NM_144997.5 (FLCN):c.1433-2A>G | 398124528 | FLCN | [ ] | ['CCCACYGGGGA GAAGGGCAGGGG', 'GCCCACYGGGGA GAAGGGCAGGG', 'GGCCCACYGGGG AGAAGGGCAGG'] | ['Hereditary cancer-predisposing syndrome', 'not provided'] |
| NM_144997.5 (FLCN):c.250-2A>G | 398124533 | FLCN | [ ] | [ ] | ['not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000146.3 (FTL):c.-160A>G | 398124633 | FTL | [ ] | [ ] | ['Hyperferritinemia cataract syndrome'] |
| NM_003184.3 (TAF2):c.1945T>C (p.Trp649Arg) | 398124645 | TAF2 | [ ] | [ ] | ['Mental retardation, autosomal recessive 40'] |
| NM_013281.3 (FLRT3):c.1016A>G (p.Lys339Arg) | 398124654 | — | [ ] | [ ] | ['Hypogonadotropic hypogonadism 21 with or without anosmia'] |
| NM_002834.3 (PTPN11):c.767A>G (p.Gln256Arg) | 397507523 | PTPN11 | [ ] | [ ] | ['Noonan syndrome 1', 'Rasopathy', 'not provided'] |
| NM_000054.4 (AVPR2):c.614A>G (p.Tyr205Cys) | 104894749 | AVPR2 | ['ACAYAGG TGCGACGG CCCCAGGG, 'GACAYAG GTGCGACG GCCCCAGG'] | ['ACAYAGGTGCG ACGGCCCCAGGG', 'GACAYAGGTGCG ACGGCCCCAGG'] | ['Nephrogenic diabetes insipidus', 'Nephrogenic diabetes insipidus, X-linked'] |
| NM_031157.2 (HNRNPA1):c.956A>G (p.Asn319Ser) | 397518454 | HNRNPA1 | [ ] | [ ] | ['Amyotrophic lateral sclerosis 20'] |
| NM_000277.1 (PAH):c.662A>G (p.Glu221Gly) | 62514934 | PAH | [ ] | [ ] | ['Phenylketonuria', 'not provided'] |
| NM_000219.5 (KCNE1):c.176T>C (p.Leu59Pro) | 141813529 | KCNE1 | [ ] | [ ] | ['Congenital long QT syndrome'] |
| NM_001165963.1 (SCN1A):c.1076A>G (p.Asn359Ser) | 794726713 | SCN1A | [ ] | [ ] | ['Severe myoclonic epilepsy in infancy'] |
| NM_013339.3 (ALG6):c.391T>C (p.Tyr131His) | 35383149 | ALG6 | [ ] | [ ] | ['Congenital disorder of glycosylation type 1C', 'not specified'] |
| NM_153767.3 (KCNJ1):c.1013T>C (p.Met338Thr) | 59172778 | KCNJ1 | [ ] | [ ] | ['Bartter syndrome antenatal type 2'] |
| NM_176824.2 (BBS7):c.968A>G (p.His323Arg) | 119466001 | BBS7 | [ ] | [ ] | ['Bardet-Biedl syndrome 7'] |
| NM_000199.3 (SGSH):c.892T>C (p.Ser298Pro) | 138504221 | SGSH | [ ] | [ ] | ['Mucopolysaccharidosis, MPS-III-A', 'not provided'] |
| NM_000891.2 (KCNJ2):c.220A>G (p.Thr74Ala) | 199473652 | KCNJ2 | | | ['Congenital long QT syndrome'] |
| NM_001165963.1 (SCN1A):c.1048A>G (p.Met350Val) | 794726768 | SCN1A | ['ACAYATA TCCCTCTG GACATTGG'] | ['ACAYATATCCCT CTGGACATTGG'] | ['Severe myoclonic epilepsy in infancy'] |
| NM_002863.4 (PYGL):c.1016A>G (p.Asn339Ser) | 113993976 | PYGL | [ ] | [ ] | ['Glycogen storage disease, type VI'] |
| NM_001165963.1 (SCN1A):c.2537A>G (p.Glu846Gly) | 794726794 | SCN1A | [ ] | [ ] | ['Severe myoclonic epilepsy in infancy'] |
| NM_002693.2 (POLG):c.2864A>G (p.Tyr955Cys) | 113994099 | POLG | [ ] | [ ] | ['Autosomal dominant progressive external ophthalmoplegia with mitochondrial DNA deletions 1'] |
| NM_000920.3 (PC):c.1705A>G (p.Thr569Ala) | 113994144 | PC | [ ] | [ ] | ['Pyruvate carboxylase deficiency'] |
| NM_025265.3 (TSEN2):c.926A>G (p.Tyr309Cys) | 113994149 | TSEN2 | [ ] | ['CAGAGCAYAGA CCAAGAAAAAGG'] | ['Pontocerebellar hypoplasia type 2B'] |
| NM_001039958.1 (MESP2):c.271A>G (p.Lys91Glu) | 113994156 | MESP2 | [ ] | [ ] | ['Spondylocostal dysostosis 2'] |

TABLE 8-continued

Human gene mutations that may be corrected by changing a guanine (G) to an
adenine (A). The gene name, gene symbol, and dbSNP database reference number (RS#) are
indicated. Also indicated are exemplary protospacers with their PAM sequences (gRNAs and
gRNAall) and the base to be edited e.g., a C, indicated by a "Y". The "gRNAs" sequences,
from top to bottom, correspond to SEQ ID NOs: 3334-3501. The "gRNA all" sequences,
from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_024649.4 (BBS1):c.1340-2A>G | 113994180 | — | [ ] | [ ] | ['Bardet-Biedl syndrome'] |
| NM_033028.4 (BBS4):c.157-2A>G | 113994192 | BBS4 | [ ] | [ ] | ['Bardet-Biedl syndrome', 'Bardet-Biedl syndrome 4'] |
| NM_212472.2 (PRKAR1A):c.1A>G (p.Met1Val) | 281864779 | PRKAR1A | [ ] | [ ] | ['Carney complex, type 1'] |
| NM_212472.2 (PRKAR1A):c.178-2A>G | 281864796 | PRKAR1A | [ ] | [ ] | ['Carney complex, type 1'] |
| NM_212472.2 (PRKAR1A):c.891+3A>G | 281864799 | PRKAR1A | [ ] | [ ] | ['Carney complex, type 1'] |
| NM_001165963.1 (SCN1A):c.433A>G (p.Met145Val) | 794726849 | SCN1A | [ ] | [ ] | ['Severe myoclonic epilepsy in infancy'] |
| NM_005710.2 (PQBP1):c.194A>G (p.Tyr65Cys) | 121917899 | PQBP1 | [ ] | [ ] | ['Renpenning syndrome 1'] |
| NM_000921.4 (PDE3A):c.1333A>G (p.Thr445Ala) | 794726865 | PDE3A | ['CGAGGYGGTGGTGGTCCAAGTGG'] | ['CGAGGYGGTGGTGGTCCAAGTGG'] | ['Brachydactyly with hypertension'] |
| NM_024312.4 (GNPTAB):c.1285-2A>G | 281864974 | GNPTAB | [ ] | [ ] | ['Pseudo-Hurler polydystrophy'] |
| NM_024312.4 (GNPTAB):c.2783A>G (p.Lys928Arg) | 281865003 | GNPTAB | [ ] | [ ] | ['I cell disease'] |
| NM_024312.4 (GNPTAB):c.2867A>G (p.His956Arg) | 281865005 | GNPTAB | [ ] | [ ] | ['Pseudo-Hurler polydystrophy'] |
| NM_024312.4 (GNPTAB):c.3053A>G (p.Asp1018Gly) | 281865007 | GNPTAB | [ ] | [ ] | ['I cell disease'] |
| NM_024312.4 (GNPTAB):c.3458A>G (p.Asn1153Ser) | 281865019 | GNPTAB | [ ] | [ ] | ['Pseudo-Hurler polydystrophy'] |
| NM_024312.4 (GNPTAB):c.118-2A>G | 281865023 | GNPTAB | [ ] | [ ] | ['I cell disease'] |
| NM_198578.3 (LRRK2):c.5605A>G (p.Met1869Val) | 281865052 | LRRK2 | [ ] | ['TCAACAYAATATTTCTAGGCAGG'] | ['Parkinson disease 8, autosomal dominant'] |
| NM_139241.3 (FGD4):c.1762-2A>G | 281865065 | FGD4 | [ ] | [ ] | ['Charcot-Marie-Tooth disease, type 4H'] |
| NM_006121.3 (KRT1):c.1445A>G (p.Tyr482Cys) | 58420087 | KRT1 | [ ] | [ ] | ['Bullous ichthyosiform erythroderma', 'not provided'] |
| NM_000195.4 (HPS1):c.716T>C (p.Leu239Pro) | 281865080 | HPS1 | [ ] | [ ] | ['Hermansky-Pudlak syndrome 1'] |
| NM_000195.4 (HPS1):c.2003T>C (p.Leu668Pro) | 281865090 | HPS1 | [ ] | [ ] | ['Hermansky-Pudlak syndrome 1'] |
| NM_022081.5(HPS4): c.461A>G (p.His154Arg) | 281865098 | HPS4 | [ ] | [ ] | ['Hermansky-Pudlak syndrome 4'] |
| NM_000277.1 (PAH):c.1157A>G (p.Tyr386Cys) | 62516141 | PAH | [ ] | [ ] | ['Phenylketonuria', 'not provided'] |
| NM_025114.3 (CEP290):c.2991+1655A>G | 281865192 | CEP290 | ['GAGATAYTCACAATTACAACTGG'] | ['GATAYTCACAATTACAACTGGGG', 'AGATAYTCACAATTACAACTGGG', 'GAGATAYTCACAATTACAACTGG'] | ['Leber congenital amaurosis 10', 'not provided'] |
| NM_018319.3 (TDP1):c.1478A>G (p.His493Arg) | 119467003 | TDP1 | [ ] | [ ] | ['Spinocerebellar ataxia autosomal recessive with axonal neuropathy'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000051.3 (ATM): c.5762_5763insNG_009830.1: g.91138_91274 | 774925473 | ATM | [ ] | [ ] | ['Ataxia-telangiectasia variant'] |
| NM_004614.4 (TK2):c.562A>G (p.Thr188Ala) | 281865495 | TK2 | [ ] | ['AAGYCTCAGGA TTGGTCCGAAGG'] | ['Mitochondrial DNA depletion syndrome 2'] |
| NM_003494.3 (DYSF):c.3041A>G (p.Tyr1014Cys) | 756328339 | DYSF | [ ] | ['CTAYACTCCCAG CCTGGGGGAGG', 'ATGCTAYACTCC CAGCCTGGGGG', 'GATGCTAYACTC CCAGCCTGGGG'] | ['Limb-girdle muscular dystrophy, type 2B'] |
| NM_000531.5 (OTC):c.1034A>G (p.Tyr345Cys) | 72558492 | OTC | ['AGGTGAG YAATCTGT CAGCAGGG'] | ['AGGTGAGYAAT CTGTCAGCAGGG'] | ['not provided'] |
| NM_000518.4 (HBB):c.199A>G (p.Lys67Glu) | 34165323 | HBB | [ ] | [ ] | ['Hemoglobinopathy'] |
| NM_153427.2 (PITX2):c.262A>G (p.Lys88Glu) | 387906810 | PITX2 | [ ] | ['TCTYGAACCAAA CCTGGGGGCGG', 'GATTCTYGAACC AAACCTGGGGG', 'CGATTCTYGAAC CAAACCTGGGG'] | ['Axenfeld-Rieger syndrome type 1'] |
| NM_030964.3 (SPRY4):c.530A>G (p.Lys177Arg) | 78310959 | SPRY4 | [ ] | ['AGTGCYTGTCCA GCTCGGGTGGG', 'AAGTGCYTGTCC AGCTCGGGTGG'] | ['Hypogonadotropic hypogonadism 17 with or without anosmia'] |
| NM_002834.3 (PTPN11):c.922A>G (p.Asn308Asp) | 28933386 | PTPN11 | [ ] | [ ] | ['Noonan syndrome', 'Noonan syndrome 1', 'Rasopathy', 'not provided'] |
| NM_000518.4 (HBB):c.-50-29A>G | 34598529 | HBB | [ ] | [ ] | ['alpha Thalassemia', 'Beta thalassemia intermedia'] |
| NM_207352.3 (CYP4V2):c.1393A>G (p.Arg465Gly) | 144109267 | CYP4V2 | [ ] | ['TTCCYGGGGCCA GCAGAGAAGGG', 'GTTCCYGGGGCC AGCAGAGAAGG'] | ['Bietti crystalline corneoretinal dystrophy'] |
| NM_001360.2 (DHCR7):c.1A>G (p.Met1Val) | 104886033 | DHCR7 | [ ] | [ ] | ['Smith-Lemli-Opitz syndrome'] |
| NM_000495.4 (COL4A5):c.1A>G (p.Met1Val) | 104886050 | COL4A5 | [ ] | [ ] | ['Alport syndrome, X-linked recessive'] |
| NM_000495.4 (COL4A5):c.2692A>G (p.Met898Val) | 104886192 | COL4A5 | [ ] | [ ] | ['Alport syndrome, X-linked recessive'] |
| NM_000495.4 (COL4A5):c.2746A>G (p.Ser916Gly) | 104886193 | COL4A5 | [ ] | [ ] | ['Alport syndrome, X-linked recessive'] |
| NM_004572.3 (PKP2):c.2062T>C (p.Ser688Pro) | 144601090 | PKP2 | [ ] | [ ] | ['Arrhythmogenic right ventricular cardiomyopathy', 'not specified', 'not provided'] |
| NM_000495.4 (COL4A5):c.4790A>G (p.Tyr1597Cys) | 104886298 | COL4A5 | [ ] | [ ] | ['Alport syndrome, X-linked recessive'] |
| NM_000495.4 (COL4A5):c.1340-2A>G | 104886319 | COL4A5 | [ ] | ['CACCYGAGTAA GATAAAGAAAGG'] | ['Alport syndrome, X-linked recessive'] |
| NM_000495.4 (COL4A5):c.2042-18A>G | 104886341 | COL4A5 | [ ] | [ ] | ['Alport syndrome, X-linked recessive'] |
| NM_000495.4 (COL4A5):c.2147-2A>G | 104886344 | COL4A5 | [ ] | [ ] | ['Alport syndrome, X-linked recessive'] |
| NM_000495.4 (COL4A5):c.2510-33A>G | 104886358 | COL4A5 | [ ] | [ ] | ['Alport syndrome, X-linked recessive'] |
| NM_000495.4 (COL4A5):c.3107-2A>G | 104886379 | COL4A5 | [ ] | [ ] | ['Alport syndrome, X-linked recessive'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000051.3 (ATM):c.7268A>G (p.Glu2423Gly) | 121434221 | ATM | [ ] | [ ] | ['Mantle cell lymphoma'] |
| NM_000495.4 (COL4A5):c.3605-2A>G | 104886385 | COL4A5 | [ ] | [ ] | ['Alport syndrome, X-linked recessive'] |
| NM_000096.3 (CP):c.1209-2A>G | 386134137 | CP | [ ] | [ ] | ['Deficiency of ferroxidase'] |
| NM_000348.3 (SRD5A2):c.692A>G (p.His231Arg) | 121434251 | SRD5A2 | [ ] | [ ] | ['3-Oxo-5 alpha-steroid delta 4-dehydrogenase deficiency'] |
| NM_002739.3 (PRKCG):c.76A>G (p.Arg26Gly) | 386134157 | PRKCG | [ ] | [ ] | ['Spinocerebellar ataxia 14'] |
| NM_000383.3 (AIRE):c.247A>G (p.Lys83Glu) | 121434255 | AIRE | [ ] | [ ] | ['AUTOIMMUNE POLYENDOCRIN-OPATHY SYNDROME, TYPE I'] |
| NM_000495.4 (COL4A5):c.466-2A>G | 104886416 | COL4A5 | [ ] | ['ACCCYAAAAGA AGCCATCAATGG'] | ['Alport syndrome, X-linked recessive'] |
| NM_001127328.2 (ACADM):c.589A>G (p.Thr197Ala) | 121434279 | ACADM | [ ] | [ ] | ['Medium-chain acyl-coenzyme A dehydrogenase deficiency'] |
| NM_000495.4 (COL4A5):c.892-2A>G | 104886453 | COL4A5 | [ ] | [ ] | ['Alport syndrome, X-linked recessive'] |
| NM_020533.2 (MCOLN1):c.406-2A>G | 104886461 | MCOLN1 | ['TACYGTG GGCAGAG AAGGGGA GG'] | ['TACYGTGGGCA GAGAAGGGGAGG', 'AGGTACYGTGGG CAGAGAAGGGG', 'CAGGTACYGTGG GCAGAGAAGGG'] | ['Ganglioside sialidase deficiency', 'not provided'] |
| NM_018136.4 (ASPM):c.2761-25A>G | 199422149 | ASPM | [ ] | [ ] | ['Primary autosomal recessive microcephaly 5'] |
| NM_017780.3 (CHD7):c.3082A>G (p.Ile1028Val) | 121434338 | CHD7 | [ ] | [ ] | ['CHARGE association', 'not provided'] |
| NM_017780.3 (CHD7):c.164A>G (p.His55Arg) | 121434345 | CHD7 | [ ] | [ ] | ['Kallmann syndrome 5'] |
| NM_152783.4 (D2HGDH):c.1315A>G (p.Asn439Asp) | 121434362 | D2HGDH | ['GCAGGTY ACCATCTC CTGGAGGG', 'TGCAGGT YACCATCT CCTGGAGG'] | ['GCAGGTYACCAT CTCCTGGAGGG', 'TGCAGGTYACCA TCTCCTGGAGG'] | [D-2-hydroxyglutaric aciduria 1'] |
| NM_005006.6 (NDUFS1):c.755A>G (p.Asp252Gly) | 199422224 | NDUFS1 | [ ] | [ ] | ['Mitochondrial complex I deficiency', 'not provided'] |
| NM_002894.2 (RBBP8):c.1009A>G (p.Lys337Glu) | 121434388 | RBBP8 | [ ] | [ ] | ['Carcinoma of pancreas'] |
| NM_004621.5 (TRPC6):c.428A>G (p.Asn143Ser) | 121434391 | TRPC6 | [ ] | [ ] | ['Focal segmental glomerulosclerosis 2'] |
| NM_003705.4 (SLC25A12):c.1769A>G (p.Gln590Arg) | 121434396 | SLC25A12 | [ ] | [ ] | ['Hypomyelination, global cerebral'] |
| NM_001363.4 (DKC1):c.127A>G (p.Lys43Glu) | 199422243 | DKC1 | [ ] | [ ] | ['Dyskeratosis congenita X-linked'] |
| NM_001084.4 (PLOD3):c.668A>G (p.Asn223Ser) | 121434414 | PLOD3 | [ ] | [ ] | ['Bone fragility with contractures, arterial rupture, and deafness'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_006702.4 (PNPLA6):c.3034A>G (p.Met1012Val) | 121434415 | PNPLA6 | [ ] | [ ] | ['Spastic paraplegia 39'] |
| NR_001566.1 (TERC):n.48A>G | 199422262 | TERC | [ ] | [ ] | ['Dyskeratosis congenita autosomal dominant'] |
| NM_004984.2 (KIF5A):c.767A>G (p.Asn256Ser) | 121434441 | KIF5A | [ ] | [ ] | ['Spastic paraplegia 10'] |
| NM_004984.2 (KIF5A):c.827A>G (p.Tyr276Cys) | 121434443 | KIF5A | [ ] | ['GAACAYAGCTTT TCTGGGGAGG'] | ['Spastic paraplegia 10'] |
| m.10438A>G | 121434456 | MT-TR | [ ] | [ ] | ['Mitochondrial encephalomyopathy'] |
| NM_198253.2 (TERT):c.2537A>G (p.Tyr846Cys) | 199422302 | TERT | [ ] | [ ] | ['Aplastic anemia'] |
| m.12320A>G | 121434463 | MT-TL2 | ['TGGAGTY GCACCAAA ATTTTTGG'] | ['GAGTYGCACCA AAATTTTTGGGG', 'GGAGTYGCACCA AAATTTTTGGG', 'TGGAGTYGCACC AAAATTTTTGG'] | ['Mitochondrial myopathy'] |
| m.4317A>G | 121434465 | MT-TI | [ ] | [ ] | [ ] |
| m.4269A>G | 121434466 | MT-TI | ['ACAYATT TCTTAGGT TTGAGGGG', 'GACAYAT TTCTTAGG TTTGAGGG'] | ['ACAYATTTCTTA GGTTTGAGGGG', 'GACAYATTTCTT AGGTTTGAGGG', 'AGACAYATTTCT TAGGTTTGAGG'] | [ ] |
| m.4295A>G | 121434467 | MT-TI | [ ] | [ ] | ['Primary familial hypertrophic cardiomyopathy', 'Deafness, nonsyndromic sensorineural, mitochondrial'] |
| m.4300A>G | 121434470 | MT-TI | [ ] | [ ] | ['Primary familial hypertrophic cardiomyopathy'] |
| NM_001099274.1 (TINF2):c.850A>G (p.Thr284Ala) | 199422314 | TINF2 | [ ] | ['TGACTGYGGGG CGCTCCTTATGG'] | ['Dyskeratosis congenita autosomal dominant'] |
| NM_004044.6 (ATIC):c.1277A>G (p.Lys426Arg) | 121434478 | ATIC | [ ] | ['AGTGTACYTGAC AGCAATGGTGG'] | ['AICAR transformylase/IMP cyclohydrolase deficiency'] |
| NM_001099274.1 (TINF2):c.871A>G (p.Arg291Gly) | 199422319 | TINF2 | [ ] | [ ] | ['Dyskeratosis congenita autosomal dominant'] |
| NM_015474.3 (SAMHD1):c.760A>G (p.Met254Val) | 121434521 | SAMHD1 | [ ] | [ ] | ['Aicardi Goutieres syndrome 5'] |
| NM_001103.3 (ACTN2):c.26A>G (p.Gln9Arg) | 121434525 | ACTN2 | [ ] | [ ] | ['Dilated cardiomyopathy 1AA', 'Cardiomyopathy', 'Dilated cardiomyopathy', 'not specified'] |
| NM_000155.3 (GALT):c.812A>G (p.Glu271Gly) | 111033765 | GALT | [ ] | ['CGCYCAGCAGG GGTCAGCTCAGG'] | ['Deficiency of UDPglucose-hexose-1-phosphate uridylyltransferase', 'not provided'] |
| NM_000316.2 (PTH1R):c.668A>G (p.His223Arg) | 121434597 | PTH1R | [ ] | [ ] | ['Metaphyseal chondrodysplasia, Jansen type'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_006006.4 (ZBTB16):c.1849A>G (p.Met617Val) | 121434606 | ZBTB16 | [ ] | ['GATCAYGGCCG AGTAGTCCCGGG', 'TGATCAYGGCCG AGTAGTCCCGG'] | ['Skeletal defects, genital hypoplasia, and mental retardation'] |
| NM_014305.3 (TGDS):c.700T>C (p.Tyr234His) | 544436734 | TGDS | [ ] | [ ] | ['Catel Manzke syndrome'] |
| NM_002835.3 (PTPN12):c.182A>G (p.Lys61Arg) | 121434623 | PTPN12 | [ ] | [ ] | ['Carcinoma of colon'] |
| NM_000035.3 (ALDOB):c.1027T>C (p.Tyr343His) | 369586696 | ALDOB | [ ] | [ ] | ['Hereditary fructosuria'] |
| NM_006180.4 (NTRK2):c.2165A>G (p.Tyr722Cys) | 121434633 | NTRK2 | [ ] | [ ] | ['Obesity, hyperphagia, and developmental delay'] |
| NM_000107.2 (DDB2):c.730A>G (p.Lys244Glu) | 121434639 | DDB2 | [ ] | [ ] | ['Xeroderma pigmentosum, group E'] |
| NM_000017.3 (ACADS):c.1108A>G (p.Met370Val) | 566325901 | ACADS | [ ] | ['AGCCCAYGCCG CCCAGGATCTGG'] | ['not provided'] |
| NM_001151.3 (SLC25A4):c.311A>G (p.Asp104Gly) | 28999114 | SLC25A4 | [ ] | [ ] | ['Autosomal dominant progressive external ophthalmoplegia with mitochondrial DNA deletions 2'] |
| NM_012079.5 (DGAT1):c.751+2T>C | 148665132 | DGAT1 | [ ] | ['ACCGCGGYGAG GACCTCTGTGGG'] | ['Diarrhea 7'] |
| NM_002036.3 (ACKR1):c.-67T>C | 2814778 | ACKR1 | [ ] | [ ] | ['White blood cell count quantitative trait locus 1'] |
| NM_000492.3 (CFTR):c.1666A>G (p.Ile556Val) | 75789129 | CFTR | [ ] | [ ] | ['Cystic fibrosis', 'not specified'] |
| NM_000155.3 (GALT):c.574A>G (p.Ser192Gly) | 111033830 | GALT | [ ] | ['TGCYGGCCCATA CCTGTCAAGGG', 'CTGCYGGCCCAT ACCTGTCAAGG'] | ['Deficiency of UDPglucose-hexose-1-phosphate uridylyltransferase'] |
| NM_174916.2 (UBR1):c.407A>G (p.His136Arg) | 119477054 | UBR1 | [ ] | [ ] | ['Johanson-Blizzard syndrome'] |
| m.3274A>G | 199474666 | MT-TL1 | [ ] | [ ] | [ ] |
| NM_000060.3 (BTD):c.128A>G (p.His43Arg) | 146011150 | BTD | [ ] | [ ] | ['Biotinidase deficiency'] |
| NM_172107.2 (KCNQ2):c.635A>G (p.Asp212Gly) | 118192202 | KCNQ2 | [ ] | [ ] | ['Benign familial neonatal seizures 1'] |
| NM_006493.2 (CLN5):c.1121A>G (p.Tyr374Cys) | 148862100 | CLN5 | [ ] | [ ] | ['Ceroid lipofuscinosis neuronal 5'] |
| NM_000060.3 (BTD):c.880A>G (p.Ile294Val) | 35976361 | BTD | [ ] | [ ] | ['Biotinidase deficiency'] |
| NM_000132.3 (F8):c.1226A>G (p.Glu409Gly) | 28933671 | F8 | [ ] | [ ] | ['Hereditary factor VIII deficiency disease'] |
| NM_000132.3 (F8):c.5600A>G (p.His1867Arg) | 28933679 | F8 | [ ] | ['GAGYGCACATCT TTTTCCTAGGG', 'TGAGYGCACATC TTTTTCCTAGG'] | ['Hereditary factor VIII deficiency disease'] |
| NM_000266.3 (NDP):c.1A>G (p.Met1Val) | 28933685 | NDP | [ ] | [ ] | ['Atrophia bulborum hereditaria'] |
| NM_000133.3 (F9):c.278A>G (p.Asp93Gly) | 137852230 | F9 | [ ] | [ ] | ['Hereditary factor IX deficiency disease'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000133.3 (F9):c.329A>G (p.Asp110Gly) | 137852234 | F9 | [ ] | [ ] | ['Hereditary factor IX deficiency disease'] |
| NM_000133.3 (F9):c.917A>G (p.Asn306Ser) | 137852251 | F9 | [ ] | ['GCTGCAYTGTAG TTGTGGTGAGG'] | ['Hereditary factor IX deficiency disease'] |
| NM_000133.3 (F9):c.1180A>G (p.Met394Val) | 137852262 | F9 | [ ] | [ ] | ['Hereditary factor IX deficiency disease'] |
| NM_000133.3 (F9):c.1231A>G (p.Ser411Gly) | 137852277 | F9 | [ ] | [ ] | ['Hereditary factor IX deficiency disease'] |
| NM_000292.2 (PHKA2):c.896A>G (p.Asp299Gly) | 137852289 | PHKA2 | [ ] | [ ] | ['Glycogen storage disease type IXa1'] |
| NM_000292.2 (PHKA2):c.565A>G (p.Lys189Glu) | 137852295 | PHKA2 | [ ] | [ ] | ['Glycogen storage disease IXa2'] |
| NM_000032.4 (ALAS2):c.1702A>G (p.Ser568Gly) | 137852306 | ALAS2 | [ ] | [ ] | ['Hereditary sideroblastic anemia'] |
| NM_001287223.1 (SCN11A):c.3473T>C (p.Leu1158Pro) | 141686175 | SCN11A | [ ] | ['CGTGCGCYGTCC CAGTTTGAAGG'] | ['Episodic pain syndrome, familial, 3'] |
| NM_000402.4 (G6PD):c.583A>G (p.Asn195Asp) | 137852331 | G6PD | [ ] | ['ATGCGGTYCCAG CCTCTGCTGGG'] | ['Favism, susceptibility to', 'Anemia, nonspherocytic hemolytic, due to G6PD deficiency'] |
| NM_000132.3 (F8):c.872A>G (p.Glu291Gly) | 137852359 | F8 | [ ] | [ ] | ['Hereditary factor VIII deficiency disease'] |
| NM_018718.2 (CEP41):c.107T>C (p.Met36Thr) | 368178632 | CEP41 | [ ] | [ ] | ['Joubert syndrome 9/15, digenic'] |
| NM_000132.3 (F8):c.5183A>G (p.Tyr1728Cys) | 137852362 | F8 | [ ] | [ ] | ['Hereditary factor VIII deficiency disease'] |
| NM_000132.3 (F8):c.5821A>G (p.Asn1941Asp) | 137852369 | F8 | [ ] | ['TAGCCATYGATT GCTGGAGAAGG'] | ['Hereditary factor VIII deficiency disease'] |
| NM_000132.3 (F8):c.328A>G (p.Met110Val) | 137852385 | F8 | [ ] | [ ] | ['Hereditary factor VIII deficiency disease'] |
| NM_000132.3 (F8):c.398A>G (p.Tyr133Cys) | 137852389 | F8 | [ ] | ['TCAYATTCAGCT CCTATAGCAGG'] | ['Hereditary factor VIII deficiency disease'] |
| NM_000132.3 (F8):c.404A>G (p.Asp135Gly) | 137852390 | F8 | [ ] | [ ] | ['Hereditary factor VIII deficiency disease'] |
| NM_000132.3 (F8):c.940A>G (p.Thr314Ala) | 137852406 | F8 | [ ] | ['TGAGCAGYAAG GAAAGTTATTGG'] | ['Hereditary factor VIII deficiency disease'] |
| NM_000041.3 (APOE):c.178A>G (p.Thr60Ala) | 28931576 | APOE | [ ] | ['ACAGTGYCTGCA CCCAGCGCAGG'] | [ ] |
| NM_000132.3 (F8):c.1682A>G (p.Asp561Gly) | 137852420 | F8 | [ ] | [ ] | ['Hereditary factor VIII deficiency disease'] |
| NM_000132.3 (F8):c.1892A>G (p.Asn631Ser) | 137852429 | F8 | ['ATGYTGG AGGCTTGG AACTCTGG'] | ['ATGYTGGAGGCT TGGAACTCTGG'] | ['Hereditary factor VIII deficiency disease'] |
| NM_012082.3 (ZFPM2):c.1969A>G (p.Ser657Gly) | 28374544 | — | [ ] | [ ] | ['Tetralogy of Fallot'] |
| NM_000098.2 (CPT2):c.638A>G (p.Asp213Gly) | 74315300 | CPT2 | [ ] | [ ] | ['CARNITINE PALMITOYL- TRANSFERASE II |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000396.3 (CTSK):c.990A>G (p.Ter330Trp) | 74315301 | CTSK | [ ] | ['GAGYCACATCTT GGGGAAGCTGG'] | DEFICIENCY, LATE-ONSET'] ['Pyknodysostosis'] |
| NM_000132.3 (F8):c.6113A>G (p.Asn2038Ser) | 137852454 | F8 | [ ] | [ ] | ['Hereditary factor VIII deficiency disease'] |
| NM_000132.3 (F8):c.6278A>G (p.Asp2093Gly) | 137852457 | F8 | [ ] | [ ] | ['Hereditary factor VIII deficiency disease'] |
| NM_024009.2 (GJB3):c.421A>G (p.Ile141Val) | 74315320 | GJB3 | ['CAAYGAT GAGCTTGA AGATGAGG'] | ['CAAYGATGAGC TTGAAGATGAGG'] | ['Deafness, autosomal recessive'] |
| NM_000132.3 (F8):c.104A>G (p.Tyr35Cys) | 137852476 | F8 | [ ] | [ ] | ['Hereditary factor VIII deficiency disease'] |
| NM_000194.2 (HPRT1):c.602A>G (p.Asp201Gly) | 137852479 | HPRT1 | [ ] | [ ] | ['Partial hypoxanthine-guanine phosphoribosyl-transferase deficiency'] |
| NM_000261.1 (MYOC):c.1267A>G (p.Lys423Glu) | 74315336 | MYOC | [ ] | [ ] | ['Primary open angle glaucoma juvenile onset 1'] |
| NM_014625.3 (NPHS2):c.479A>G (p.Asp160Gly) | 74315346 | NPHS2 | [ ] | [ ] | ['Nephrotic syndrome, idiopathic, steroid-resistant'] |
| NM_000194.2 (HPRT1):c.155A>G (p.Asp52Gly) | 137852502 | HPRT1 | [ ] | [ ] | ['Partial hypoxanthine-guanine phosphoribosyl-transferase deficiency'] |
| NM_002764.3 (PRPS1):c.341A>G (p.Asn114Ser) | 137852540 | PRPS1 | [ ] | ['TAGCATAYTTGC AACAAGCTTGG'] | ['Phosphoribosyl-pyrophosphate synthetase superactivity'] |
| NM_000055.2 (BCHE):c.293A>G (p.Asp98Gly) | 1799807 | BCHE | [ ] | [ ] | ['Postanesthetic apnea'] |
| NM_170784.2 (MKKS):c.169A>G (p.Thr57Ala) | 74315399 | MKKS | [ ] | [ ] | ['Bardet-Biedl syndrome 6'] |
| NM_000311.3 (PRNP):c.650A>G (p.Gln217Arg) | 74315406 | PRNP | [ ] | [ ] | ['Gerstmann-Straussler-Scheinker syndrome', 'Genetic prion diseases'] |
| NM_000311.3 (PRNP):c.560A>G (p.His187Arg) | 74315413 | PRNP | [ ] | [ ] | ['Gerstmann-Straussler-Scheinker syndrome', 'Genetic prion diseases', 'Spongiform encephalopathy with neuropsychiatric features'] |
| NM_000044.3 (AR):c.2291A>G (p.Tyr764Cys) | 137852567 | AR | [ ] | [ ] | ['Reifenstein syndrome'] |
| NM_000044.3 (AR):c.2362A>G (p.Met788Val) | 137852570 | AR | [ ] | [ ] | [ ] |
| NM_000044.3 (AR):c.2632A>G (p.Thr878Ala) | 137852578 | AR | [ ] | [ ] | ['Malignant tumor of prostate'] |
| NM_020436.3 (SALL4):c.2663A>G (p.His888Arg) | 74315429 | SALL4 | [ ] | [ ] | ['Duane-radial ray syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000044.3 (AR):c.2708A>G (p.Gln903Arg) | 137852582 | AR | [ ] | [ ] | ['Malignant tumor of prostate'] |
| NM_000211.4 (ITGB2):c.1052A>G (p.Asn351Ser) | 137852613 | ITGB2 | [ ] | [ ] | ['Leukocyte adhesion deficiency'] |
| NM_000215.3 (JAK3):c.299A>G (p.Tyr100Cys) | 137852624 | JAK3 | [ ] | ['AATCCTGYACAG CAGGACTTGGG'] | ['Severe combined immunodeficiency, autosomal recessive, T cell-negative, B cell-positive, NK cell-negative'] |
| NM_001166107.1 (HMGCS2):c.500A>G (p.Tyr167Cys) | 137852640 | HMGCS2 | [ ] | ['ACCACCGYAGC AGGCATTGGTGG'] | ['mitochondrial 3-hydroxy-3-methylglutaryl-CoA synthase deficiency'] |
| NM_002047.2 (GARS):c.374A>G (p.Glu125Gly) | 137852645 | GARS | [ ] | [ ] | ['Charcot-Marie-Tooth disease type 2D', 'Distal hereditary motor neuronopathy type 5'] |
| NM_033163.3 (FGF8):c.298A>G (p.Lys100Glu) | 137852662 | FGF8 | [ ] | [ ] | ['Kallmann syndrome 6'] |
| NM_002180.2 (IGHMBP2):c.638A>G (p.His213Arg) | 137852666 | IGHMBP2 | [ ] | [ ] | ['Werdnig-Hoffmann disease'] |
| NM_004387.3 (NKX2-5):c.896A>G (p.Asp299Gly) | 137852683 | NKX2-5 | [ ] | [ ] | ['Atrial septal defect 7 with or without atrioventricular conduction defects'] |
| NM_004387.3 (NKX2-5):c.547A>G (p.Lys183Glu) | 137852686 | NKX2-5 | [ ] | [ ] | [ ] |
| NM_000310.3 (PPT1):c.236A>G (p.Asp79Gly) | 137852697 | PPT1 | [ ] | [ ] | ['Ceroid lipofuscinosis neuronal 1'] |
| NM_000336.2 (SCNN1B):c.863A>G (p.Asn288Ser) | 137852712 | SCNN1B | [ ] | [ ] | ['Bronchiectasis'] |
| NM_000579.3 (CCR5):c.-301+246A>G | 1799987 | — | [ ] | [ ] | ['Human immunodeficiency virus type 1, susceptibility to'] |
| NM_001204.6 (BMPR2):c.1454A>G (p.Asp485Gly) | 137852745 | BMPR2 | [ ] | [ ] | ['Primary pulmonary hypertension'] |
| NM_005591.3 (MRE11A):c.350A>G (p.Asn117Ser) | 137852760 | MRE11A | [ ] | [ ] | ['Hereditary cancer-predisposing syndrome', 'Ataxia-telangiectasia-like disorder'] |
| NM_003476.4 (CSRP3):c.206A>G (p.Lys69Arg) | 137852764 | CSRP3 | [ ] | [ ] | ['Dilated cardiomyopathy 1M', 'Cardiomyopathy', 'Familial hypertrophic cardiomyopathy 12'] |
| NM_000519.3 (HBD):c.-81A>G | 35518301 | HBD | [ ] | [ ] | [ ] |
| NM_005633.3 (SOS1):c.1654A>G (p.Arg552Gly) | 137852814 | SOS1 | [ ] | ['GCATCCYTTCCA GTGTACTCCGG'] | ['Noonan syndrome', 'Noonan syndrome 4', 'Rasopathy', 'not provided'] |
| NM_003688.3 (CASK):c.2129A>G (p.Asp710Gly) | 137852818 | CASK | [ ] | [ ] | ['FG syndrome 4'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_031443.3 (CCM2):c.1A>G (p.Met1Val) | 137852842 | CCM2 | [ ] | [ ] | ['Cerebral cavernous malformations 2'] |
| NM_182760.3 (SUMF1):c.1A>G (p.Met1Val) | 137852855 | SUMF1 | [ ] | [ ] | ['Multiple sulfatase deficiency'] |
| NM_001171993.1 (HPD):c.362A>G (p.Tyr121Cys) | 137852865 | HPD | [ ] | ['CCTCAYATCCAG GCAAGAATTGG'] | [4-Hydroxyphenyl-pyruvate dioxygenase deficiency'] |
| NM_024996.5 (GFM1):c.521A>G (p.Asn174Ser) | 119470018 | GFM1 | ['TTGYTAA TAAAAGTT AGAAACG G'] | ['TTGYTAATAAAA GTTAGAAACGG'] | ['Combined oxidative phosphorylation deficiency 1'] |
| NM_000158.3 (GBE1):c.1634A>G (p.His545Arg) | 137852889 | GBE1 | [ ] | [ ] | ['Glycogen storage disease, type IV', 'GLYCOGEN STORAGE DISEASE IV, FATAL PERINATAL NEUROMUSCULAR'] |
| NM_000158.3 (GBE1):c.1883A>G (p.His628Arg) | 137852891 | GBE1 | [ ] | [ ] | ['Glycogen storage disease, type IV', 'GLYCOGEN STORAGE DISEASE IV, CHILDHOOD NEUROMUSCULAR] |
| m.8344A>G | 118192098 | MT-TK | [ ] | [ ] | ['Parkinson disease, mitochondrial', 'Leigh disease', 'Myoclonus with epilepsy with ragged red fibers'] |
| NM_000540.2 (RYR1):c.10100A>G (p.Lys3367Arg) | 118192126 | RYR1 | [ ] | [ ] | ['Central core disease', 'not provided'] |
| NM_000540.2 (RYR1):c.14572A>G (p.Asn4858Asp) | 118192144 | RYR1 | [ ] | [ ] | ['Central core disease', 'not provided'] |
| NM_012464.4 (TLL1):c.1885A>G (p.Ile629Val) | 137852953 | TLL1 | ['GGTTAYG GTGCCGTT AAGTTTGG'] | ['GGTTAYGGTGCC GTTAAGTTTGG'] | ['Atrial septal defect 6'] |
| NM_025243.3 (SLC19A3):c.130A>G (p.Lys44Glu) | 137852957 | SLC19A3 | [ ] | [ ] | ['Basal ganglia disease, biotin-responsive'] |
| NM_138691.2 (TMC1):c.1763+3A>G | 370898981 | TMC1 | [ ] | ['TGGCCYACCAG ATCATGCCTTGG'] | ['Deafness, autosomal recessive 7'] |
| NM_000540.2 (RYR1):c.13909A>G (p.Thr4637Ala) | 118192166 | RYR1 | [ ] | [ ] | ['Central core disease', 'not provided'] |
| NM_000540.2 (RYR1):c.14387A>G (p.Tyr4796Cys) | 118192167 | RYR1 | [ ] | ['CCATAYACCAGC CCAGGTACAGG'] | ['Malignant hyperthermia susceptibility type 1', 'Central core disease', 'not provided'] |
| NM_032667.6 (BSCL2):c.263A>G (p.Asn88Ser) | 137852972 | — | [ ] | ['CGAGACAYTGG CAACAGGGAAGG'] | ['Distal hereditary motor neuronopathy type 5', 'Silver spastic paraplegia syndrome', 'Charcot-Marie-Tooth disease, type 2'] |
| NM_014795.3 (ZEB2):c.3356A>G (p.Gln1119Arg) | 137852983 | ZEB2 | [ ] | [ ] | ['Mowat-Wilson syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000540.2 (RYR1):c.14740A>G (p.Arg4914Gly) | 118192184 | RYR1 | [ ] | [ ] | ['Central core disease', 'not provided'] |
| NM_172107.2 (KCNQ2):c.356A>G (p.Glu119Gly) | 118192193 | KCNQ2 | [ ] | ['CTTCYCATACTC CTTGATGGTGG', 'GCTCTTCYCATA CTCCTTGATGG'] | ['Benign familial neonatal seizures 1'] |
| NM_172107.2 (KCNQ2):c.622A>G (p.Met208Val) | 118192201 | KCNQ2 | [ ] | ['GGATCAYCCGC AGAATCTGCAGG'] | ['Benign familial neonatal seizures 1'] |
| NM_172107.2 (KCNQ2):c.773A>G (p.Asn258Ser) | 118192207 | KCNQ2 | [ ] | [ ] | ['Benign familial neonatal seizures 1'] |
| NM_004006.2 (DMD):c.8734A>G (p.Asn2912Asp) | 1800278 | DMD | [ ] | [ ] | ['Duchenne muscular dystrophy', 'not specified'] |
| NM_004006.2 (DMD):c.8762A>G (p.His2921Arg) | 1800279 | DMD | [ ] | [ ] | ['Becker muscular dystrophy', 'not specified'] |
| NM_001080463.1 (DYNC2H1):c.11284A>G (p.Met3762Val) | 137853026 | DYNC2H1 | [ ] | [ ] | ['Short-rib thoracic dysplasia 3 with or without polydactyly'] |
| NM_001080463.1 (DYNC2H1):c.9044A>G (p.Asp3015Gly) | 137853027 | DYNC2H1 | [ ] | ['ATAYCTCTAATT ACATCAGGTGG', 'AGAATAYCTCTA ATTACATCAGG'] | ['Short-rib thoracic dysplasia 3 with or without polydactyly'] |
| NM_001080463.1 (DYNC2H1):c.4610A>G (p.Gln1537Arg) | 137853033 | DYNC2H1 | ['ACCYGTG AAGGGAA CAGAGATG G'] | ['ACCYGTGAAGG GAACAGAGATGG'] | ['Short-rib thoracic dysplasia 3 with or without polydactyly'] |
| NM_001080463.1 (DYNC2H1):c.5959A>G (p.Thr1987Ala) | 137853035 | DYNC2H1 | [ ] | [ ] | ['Short-rib thoracic dysplasia 3 with or without polydactyly'] |
| NM_001430.4 (EPAS1):c.1603A>G (p.Met535Val) | 137853037 | EPAS1 | [ ] | [ ] | ['Erythrocytosis, familial, 4'] |
| NM_172107.2 (KCNQ2):c.1764-2A>G | 118192238 | KCNQ2 | [ ] | [ ] | ['Benign familial neonatal seizures 1'] |
| NM_004519.3 (KCNQ3):c.914A>G (p.Asp305Gly) | 118192248 | KCNQ3 | [ ] | [ ] | ['Benign familial neonatal seizures 2'] |
| NM_004519.3 (KCNQ3):c.1403A>G (p.Asn468Ser) | 118192252 | KCNQ3 | ['TCTTTAY TGTTTAAG CCAACAGG'] | ['TCTTTAYTGTTT AAGCCAACAGG'] | ['Benign familial neonatal seizures 2', 'not specified', 'not provided'] |
| NM_004519.3 (KCNQ3):c.2462A>G (p.Asn821Ser) | 118192254 | KCNQ3 | [ ] | [ ] | ['Benign familial neonatal seizures 2', 'not specified', 'not provided'] |
| NM_138701.3 (MPLKIP):c.430A>G (p.Met144Val) | 137853117 | MPLKIP | [ ] | [ ] | ['Trichothiodystrophy, nonphotosensitive 1'] |
| NM_005094.3 (SLC27A4):c.899A>G (p.Gln300Arg) | 137853134 | SLC27A4 | [ ] | [ ] | ['Ichthyosis prematurity syndrome'] |
| NM_194456.1 (KRIT1):c.410A>G (p.Asp137Gly) | 137853139 | KRIT1 | [ ] | [ ] | ['Cerebral cavernous malformations 1'] |
| NM_000351.4 (STS):c.1331A>G (p.His444Arg) | 137853169 | STS | [ ] | [ ] | ['X-linked ichthyosis with steryl-sulfatase deficiency'] |
| NM_152416.3 (NDUFAF6):c.296A>G (p.Gln99Arg) | 137853184 | NDUFAF6 | [ ] | [ ] | ['Leigh syndrome due to mitochondrial complex I deficiency'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_144573.3 (NEXN):c.1955A>G (p.Tyr652Cys) | 137853197 | NEXN | [ ] | ['ATAYACTCTCCT CCATCTTCTGG'] | ['Dilated cardiomyopathy 1CC', 'Cardiomyopathy', 'not specified'] |
| NM_000476.2 (AK1):c.491A>G (p.Tyr164Cys) | 137853203 | AK1 | [ ] | ['TTCTCAYAGAAG GCGATGACGGG', 'TTTCTCAYAGAA GGCGATGACGG'] | ['Adenylate kinase deficiency, hemolytic anemia due to'] |
| NM_013411.4 (AK2):c.1A>G (p.Met1Val) | 137853206 | AK2 | [ ] | [ ] | ['Reticular dysgenesis'] |
| NM_000308.2 (CTSA):c.746+3A>G | 786200859 | CTSA | [ ] | ['TCCCAYACCTGT TCCCCAGAAGG'] | ['Galactosialidosis, adult'] |
| NM_002890.2 (RASA1):c.1198A>G (p.Lys400Glu) | 137853215 | RASA1 | [ ] | [ ] | [ ] |
| NM_002890.2 (RASA1):c.1201A>G (p.Ile401Val) | 137853216 | RASA1 | [ ] | [ ] | [ ] |
| NM_000515.4 (GH1):c.413A>G (p.Asp138Gly) | 137853221 | GH1 | [ ] | [ ] | ['Kowarski syndrome'] |
| NM_017636.3 (TRPM4):c.2741A>G (p.Lys914Arg) | 172151858 | TRPM4 | [ ] | [ ] | ['Progressive familial heart block type 1B'] |
| NM_000545.6 (HNF1A):c.365A>G (p.Tyr122Cys) | 137853237 | HNF1A | [ ] | [ ] | ['Maturity-onset diabetes of the young, type 3'] |
| NM_003494.3 (DYSF):c.1285-2A>G | 786200897 | DYSF | [ ] | ['CAGCYAGAAGA CACAGGGAGGGG', 'ACAGCYAGAAGA CACAGGGAGGG', 'CACAGCYAGAAG ACACAGGGAGG'] | ['Limb-girdle muscular dystrophy, type 2B'] |
| NM_005055.4 (RAPSN):c.-210A>G | 786200905 | RAPSN | [ ] | [ ] | ['MYASTHENIC SYNDROME, CONGENITAL, 11, ASSOCIATED WITH ACETYLCHOLINE RECEPTOR DEFICIENCY'] |
| NM_000276.3 (OCRL):c.1436A>G (p.Tyr479Cys) | 137853262 | OCRL | [ ] | [ ] | ['Dent disease 2'] |
| NM_004463.2 (FGD1):c.1396A>G (p.Met466Val) | 137853267 | FGD1 | [ ] | [ ] | ['Aarskog syndrome'] |
| NM_153252.4 (BRWD3):c.4786A>G (p.Lys1596Glu) | 137853272 | BRWD3 | [ ] | [ ] | ['Mental retardation, X-linked 93'] |
| NM_206933.2 (USH2A):c.7595-2144A>G | 786200928 | USH2A | [ ] | ['CTCTTAYCTTGG GAAAGGAGAGG'] | ['Usher syndrome, type 2A'] |
| NM_000362.4 (TIMP3):c.572A>G (p.Tyr191Cys) | 137853299 | — | ['TGCAGYA GCCGCCCT TCTGCCGG'] | ['TGCAGYAGCCG CCCTTCTGCCGG'] | ['Sorsby fundus dystrophy'] |
| NM_006785.3 (MALT1):c.1019-2A>G | 786200953 | MALT1 | ['CGCYTTG AAAAAAA AAGAAAG GG'] | ['CGCYTTGAAAA AAAAAGAAAGGG', 'TCGCYTTGAAAA AAAAAGAAAGG'] | ['Combined immunodeficiency'] |
| NM_003639.4 (IKBKG):c.1259A>G (p.Ter420Trp) | 137853321 | IKBKG | [ ] | [ ] | ['Incontinentia pigmenti syndrome', 'Ectodermal dysplasia, anhidrotic, with immunodeficiency, osteopetrosis, and lymphedema'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_003639.4 (IKBKG):c.1219A>G (p.Met407Val) | 137853322 | IKBKG | [ ] | ['CCAYATCAGGG GCCTGATACTGG'] | ['Incontinentia pigmenti syndrome'] |
| NM_001014797.2 (KCNMA1):c.1301A>G (p.Asp434Gly) | 137853333 | KCNMA1 | [ ] | [ ] | ['Generalized epilepsy and paroxysmal dyskinesia'] |
| NM_016218.2 (POLK):c.1679A>T (p.Glu560Val) | 757103131 | POLK | [ ] | [ ] | ['Malignant tumor of prostate'] |
| NM_003000.2 (SDHB):c.541-2A>G | 786201161 | SDHB | [ ] | [ ] | ['Hereditary cancer-predisposing syndrome'] |
| NM_032383.4 (HPS3):c.2482-2A>G | 397507168 | — | [ ] | [ ] | ['Hermansky-Pudlak syndrome 3'] |
| NM_000060.3 (BTD):c.968A>G (p.His323Arg) | 397507176 | BTD | [ ] | [ ] | ['Biotinidase deficiency', 'not provided'] |
| NM_004315.4 (ASAH1):c.155A>G (p.Tyr52Cys) | 137853595 | ASAH1 | [ ] | [ ] | ['Farber lipogranulomatosis'] |
| NM_004315.4 (ASAH1):c.1006A>G (p.Asn336Asp) | 137853596 | ASAH1 | [ ] | [ ] | ['Farber lipogranulomatosis'] |
| NM_000059.3 (BRCA2):c.1799A>G (p.Tyr600Cys) | 397507276 | BRCA2 | [ ] | [ ] | ['Breast-ovarian cancer, familial 2'] |
| NM_022912.2 (REEP1):c.183-2A>G | 387906264 | REEP1 | [ ] | [ ] | ['Spastic paraplegia 31, autosomal dominant'] |
| NM_000022.2 (ADA):c.219-2A>G | 387906267 | ADA | [ ] | ['CCCCYGGGAAG GGAAGAAAGGGG', 'GCCCCYGGGAAG GGAAGAAAGGG', 'AGCCCCYGGGAA GGGAAGAAAGG'] | ['Severe combined immunodeficiency due to ADA deficiency'] |
| NM_018249.5 (CDK5RAP2):c.4005-15A>G | 387906274 | CDK5RAP2 | [ ] | [ ] | ['Primary autosomal recessive microcephaly 3'] |
| NM_032119.3 (ADGRV1):c.14973-2A>G | 371981035 | ADGRV1 | [ ] | [ ] | ['Usher syndrome, type 2C'] |
| NM_020366.3 (RPGRIP1):c.3341A>G (p.Asp1114Gly) | 17103671 | RPGRIP1 | [ ] | [ ] | ['Leber congenital amaurosis 6', 'not specified'] |
| NM_000492.3 (CFTR):c.3717+4A>G | 387906362 | CFTR | [ ] | ['TCAAATCYCACC CTCTGGCCAGG'] | ['Cystic fibrosis'] |
| NM_000492.3 (CFTR):c.273+4A>G | 387906374 | CFTR | [ ] | [ ] | ['Cystic fibrosis'] |
| NM_002769.4 (PRSS1):c.65A>G (p.Asp22Gly) | 397507442 | — | [ ] | ['CTTGYCATCATC ATCAAAGGGGG', 'TCTTGYCATCATC ATCAAAGGGG', 'ATCTTGYCATCA TCATCAAAGGG', 'GATCTTGYCATC ATCATCAAAGG'] | ['Hereditary pancreatitis'] |
| NM_004006.2 (DMD):c.4675-2A>G | 794727575 | DMD | [ ] | [ ] | ['Duchenne muscular dystrophy', 'Becker muscular dystrophy'] |
| NM_000132.3 (F8):c.1418A>G (p.Tyr473Cys) | 387906444 | F8 | [ ] | [ ] | ['Hereditary factor VIII deficiency disease'] |
| NM_004333.4 (BRAF):c.2126A>G (p.Gln709Arg) | 397507486 | BRAF | [ ] | [ ] | ['Rasopathy'] |
| NM_002834.3 (PTPN11):c.124A>G (p.Thr42Ala) | 397507501 | PTPN11 | [ ] | [ ] | ['Noonan syndrome', 'Noonan syndrome 1', 'Rasopathy', 'not provided'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000834.3 (GRIN2B):c.1238A>G (p.Glu413Gly) | 527236034 | GRIN2B | [ ] | [ ] | ['Mental retardation, autosomal dominant 6'] |
| NM_004830.3 (MED23):c.3638A>G (p.His1213Arg) | 527236035 | MED23 | [ ] | [ ] | ['Mental retardation, autosomal recessive 18'] |
| NM_002834.3 (PTPN11):c.844A>G (p.Ile282Val) | 397507529 | PTPN11 | [ ] | [ ] | ['Noonan syndrome 1', 'Rasopathy', 'not provided'] |
| NM_000406.2 (GNRHR):c.851A>G (p.Tyr284Cys) | 28933074 | GNRHR | [ ] | [ ] | [ ] |
| NM_002834.3 (PTPN11):c.1510A>G (p.Met504Val) | 397507547 | PTPN11 | [ ] | [ ] | ['Noonan syndrome', 'Noonan syndrome 1', 'Rasopathy', 'not provided'] |
| NM_004629.1 (FANCG):c.925-2A>G | 397507561 | FANCG | [ ] | [ ] | ['Fanconi anemia, complementation group G'] |
| NM_000492.3 (CFTR):c.3140-26A>G | 76151804 | CFTR | [ ] | [ ] | ['Cystic fibrosis'] |
| NM_024598.3 (USB1):c.502A>G (p.Arg168Gly) | 137853971 | USB1 | [ ] | ['CCACCYGGTTTT CTCTTGATTGG'] | ['Poikiloderma with neutropenia'] |
| NM_000067.2 (CA2):c.754A>G (p.Asn252Asp) | 2228063 | CA2 | [ ] | ['TGTYCTTCAGTG GCTGAGCTGGG', 'CTGTYCTTCAGT GGCTGAGCTGG'] | [ ] |
| NM_000138.4 (FBN1):c.5096A>G (p.Tyr1699Cys) | 387906622 | FBN1 | [ ] | [ ] | ['Geleophysic dysplasia 2'] |
| NM_001194958.2 (KCNJ18):c.1097A>G (p.Lys366Arg) | 527236159 | KCNJ18 | [ ] | [ ] | ['Thyrotoxic periodic paralysis', 'Thyrotoxic periodic paralysis 2'] |
| NM_000138.4 (FBN1):c.5087A>G (p.Tyr1696Cys) | 387906625 | FBN1 | [ ] | [ ] | ['Geleophysic dysplasia 2'] |
| NM_000138.4 (FBN1):c.5099A>G (p.Tyr1700Cys) | 387906626 | FBN1 | [ ] | [ ] | [ ] |
| NM_001244710.1 (GFPT1):c.43A>G (p.Thr15Ala) | 387906638 | GFPT1 | [ ] | [ ] | ['Congenital myasthenic syndrome with tubular aggregates 1'] |
| NM_002292.3 (LAMB2):c.440A>G (p.His147Arg) | 387906644 | LAMB2 | [ ] | [ ] | ['Nephrotic syndrome, type 5, with or without ocular abnormalities'] |
| NM_005188.3 (CBL):c.1112A>G (p.Tyr371Cys) | 387906666 | CBL | [ ] | [ ] | [ ] |
| NM_000313.3 (PROS1):c.701A>G (p.Tyr234Cys) | 387906675 | PROS1 | ['GATTAYA TCTGTAGC CTTCGGGG', 'AGATTAY ATCTGTAG CCTTCGGG', 'GAGATTA YATCTGTA GCCTTCGG'] | ['GATTAYATCTGT AGCCTTCGGGG', 'AGATTAYATCTG TAGCCTTCGGG', 'GAGATTAYATCT GTAGCCTTCGG'] | ['Thrombophilia due to protein S deficiency, autosomal recessive'] |
| NM_032018.6 (SPRTN):c.350A>G (p.Tyr117Cys) | 527236213 | SPRTN | [ ] | [ ] | ['Ruijs-aalfs syndrome'] |
| NM_022464.4 (SIL1):c.645+2T>C | 548535414 | SIL1 | [ ] | [ ] | ['Marinesco-Sj\xc3\xb6gren syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001040142.1 (SCN2A):c.4419A>G (p.Ile1473Met) | 387906685 | SCN2A | [ ] | [ ] | ['Early infantile epileptic encephalopathy 11'] |
| NM_001040142.1 (SCN2A):c.754A>G (p.Met252Val) | 387906687 | SCN2A | [ ] | [ ] | ['Benign familial neonatal-infantile seizures'] |
| m.10450A>G | 387906731 | MT-TR | [ ] | [ ] | ['Mitochondrial encephalomyopathy'] |
| m.5816A>G | 387906732 | MT-TC | [ ] | [ ] | [ ] |
| m.608A>G | 387906735 | MT-TF | ['TTCAGYGTATTGCTTTGAGGAGG'] | ['TTCAGYGTATTGCTTTGAGGAGG'] | [ ] |
| NM_001376.4 (DYNC1H1):c.917A>G (p.His306Arg) | 387906738 | DYNC1H1 | [ ] | [ ] | ['Charcot-Marie-Tooth disease, axonal, type 2O', 'Charcot-Marie-Tooth disease', 'Spinal muscular atrophy, lower extremity predominant 1, autosomal dominant'] |
| NM_001376.4 (DYNC1H1):c.2011A>G (p.Lys671Glu) | 387906742 | DYNC1H1 | [ ] | [ ] | ['Spinal muscular atrophy, lower extremity predominant 1, autosomal dominant'] |
| NM_001376.4 (DYNC1H1):c.2909A>G (p.Tyr970Cys) | 387906743 | DYNC1H1 | [ ] | ['ATTCAAGYAGATTACCTGATTGG'] | ['Spinal muscular atrophy, lower extremity predominant 1, autosomal dominant'] |
| NM_001354.5 (AKR1C2):c.235A>G (p.Ile79Val) | 387906750 | AKR1C2 | [ ] | [ ] | ['46,XY sex reversal 8'] |
| NM_007315.3 (STAT1):c.604A>G (p.Met202Val) | 387906762 | STAT1 | [ ] | [ ] | ['Immunodeficiency 31C'] |
| NM_007315.3 (STAT1):c.494A>G (p.Asp165Gly) | 387906764 | STAT1 | [ ] | [ ] | ['Immunodeficiency 31C'] |
| NM_007315.3 (STAT1):c.862A>G (p.Thr288Ala) | 387906765 | STAT1 | [ ] | [ ] | ['Immunodeficiency 31C'] |
| NM_002052.4 (GATA4):c.928A>G (p.Met310Val) | 387906772 | GATA4 | [ ] | ['TCCGCAYTGCAAGAGGCCTGGGG', 'TTCCGCAYTGCAAGAGGCCTGGG'] | ['Atrial septal defect 2'] |
| NM_021615.4 (CHST6):c.329A>G (p.Tyr110Cys) | 72547544 | CHST6 | [ ] | [ ] | ['Macular corneal dystrophy Type I'] |
| NM_000209.3 (PDX1):c.533A>G (p.Glu178Gly) | 387906777 | PDX1 | [ ] | [ ] | ['Pancreatic agenesis, congenital'] |
| NM_000890.3 (KCNJ5):c.472A>G (p.Thr158Ala) | 387906778 | KCNJ5 | [ ] | [ ] | ['Andersen Tawil syndrome', 'Familial hyperaldosteronism type 3'] |
| NM_001184.3 (ATR):c.6431A>G (p.Gln2144Arg) | 387906797 | ATR | [ ] | [ ] | ['Cutaneous telangiectasia and cancer syndrome, familial'] |
| NM_000382.2 (ALDH3A2):c.1157A>G (p.Asn386Ser) | 72547575 | ALDH3A2 | [ ] | [ ] | ['Sj\xc3\xb6gren-Larsson syndrome'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_001005862.2 (ERBB2):c.2480A>G (p.Asn827Ser) | 28933370 | ERBB2 | [ ] | [ ] | ['Neoplasm of ovary'] |
| NM_006194.3 (PAX9):c.271A>G (p.Lys91Glu) | 28933373 | PAX9 | [ ] | [ ] | ['Tooth agenesis, selective, 3'] |
| NM_001083116.1 (PRF1):c.755A>G (p.Asn252Ser) | 28933375 | PRF1 | [ ] | [ ] | ['Hemophagocytic lymphohistiocytosis, familial, 2', 'Malignant lymphoma, non-Hodgkin'] |
| NM_005257.5 (GATA6):c.1354A>G (p.Thr452Ala) | 387906817 | GATA6 | [ ] | [ ] | ['Pancreatic agenesis and congenital heart disease'] |
| NM_000414.3 (HSD17B4):c.650A>G (p.Tyr217Cys) | 387906825 | HSD17B4 | [ ] | ['TGCCACAYACTC TGGCTTCAGGG'] | ['Gonadal dysgenesis with auditory dysfunction, autosomal recessive inheritance'] |
| NM_004153.3 (ORC1):c.380A>G (p.Glu127Gly) | 387906826 | ORC1 | [ ] | [ ] | ['Meier-Gorlin syndrome 1'] |
| NM_002552.4 (ORC4):c.521A>G (p.Tyr174Cys) | 387906847 | ORC4 | [ ] | [ ] | ['Meier-Gorlin syndrome 2'] |
| NM_004544.3 (NDUFA10):c.1A>G (p.Met1Val) | 387906872 | NDUFA10 | [ ] | [ ] | ['Leigh syndrome due to mitochondrial complex I deficiency'] |
| NM_004544.3 (NDUFA10):c.425A>G (p.Gln142Arg) | 387906873 | NDUFA10 | [ ] | [ ] | ['Leigh syndrome due to mitochondrial complex I deficiency'] |
| NM_006796.2 (AFG3L2):c.1847A>G (p.Tyr616Cys) | 387906889 | AFG3L2 | ['GTAYAGA GGTATTGT TCTTTTGG'] | ['GTAYAGAGGTA TTGTTCTTTTGG'] | ['Spastic ataxia 5, autosomal recessive'] |
| NM_006587.3 (CORIN):c.949A>G (p.Lys317Glu) | 387906894 | CORIN | [ ] | [ ] | ['Preeclampsia/ eclampsia 5'] |
| NM_006587.3 (CORIN):c.1414A>G (p.Ser472Gly) | 387906895 | CORIN | [ ] | ['GGATAACYTGTA CTGTTGTAGGG'] | ['Preeclampsia/ eclampsia 5'] |
| NM_015560.2 (OPA1):c.1294A>G (p.Ile432Val) | 387906899 | OPA1 | [ ] | [ ] | ['Optic Atrophy Type 1'] |
| NM_021625.4 (TRPV4):c.590A>G (p.Lys197Arg) | 387906903 | TRPV4 | [ ] | [ ] | ['Metatrophic dysplasia'] |
| NM_021625.4 (TRPV4):c.826A>G (p.Lys276Glu) | 387906907 | TRPV4 | [ ] | [ ] | ['Metatrophic dysplasia'] |
| NM_024022.2 (TMPRSS3):c.308A>G (p.Asp103Gly) | 387906915 | TMPRSS3 | [ ] | [ ] | ['Deafness, autosomal recessive 8'] |
| NM_019109.4 (ALG1):c.1129A>G (p.Met377Val) | 387906925 | ALG1 | [ ] | [ ] | ['Congenital disorder of glycosylation type 1K'] |
| NM_006886.3 (ATP5E):c.35A>G (p.Tyr12Cys) | 387906929 | — | [ ] | [ ] | ['Nuclearly-encoded mitochondrial complex V (ATP synthase) deficiency 3'] |
| NM_032578.3 (MYPN):c.59A>G (p.Tyr20Cys) | 140148105 | MYPN | [ ] | [ ] | ['Primary dilated cardiomyopathy', 'Cardiomyopathy', 'Dilated cardiomyopathy 1KK', 'Familial |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| | | | | | hypertrophic cardiomyopathy 22', 'not provided'] |
| NM_016013.3 (NDUFAF1):c.758A>G (p.Lys253Arg) | 387906957 | NDUFAF1 | [ ] | ['ACCYTGACCTCC TGCCAGTAGGG', 'TACCYTGACCTC CTGCCAGTAGG'] | ['Mitochondrial complex I deficiency'] |
| NM_032580.3 (HES7):c.172A>G (p.Ile58Val) | 387906979 | HES7 | [ ] | [ ] | ['Spondylocostal dysostosis 5'] |
| NM_024700.3 (SNIP1):c.1097A>G (p.Glu366Gly) | 387906986 | SNIP1 | [ ] | [ ] | ['Psychomotor retardation, epilepsy, and craniofacial dysmorphism'] |
| NM_016952.4 (CDON):c.2368A>G (p.Thr790Ala) | 387906997 | CDON | [ ] | [ ] | ['Holoprosencephaly 11'] |
| NM_031427.3 (DNAL1):c.449A>G (p.Asn150Ser) | 387907021 | DNAL1 | ['AGGGAYT GCCTACAA ACACCAGG'] | ['AGGGAYTGCCT ACAAACACCAGG'] | ['Kartagener syndrome', 'Ciliary dyskinesia, primary, 16'] |
| NM_020320.3 (RARS2):c.1024A>G (p.Met342Val) | 387907048 | RARS2 | [ ] | [ ] | ['Pontocerebellar hypoplasia type 6'] |
| NM_000138.4 (FBN1):c.6431A>G (p.Asn2144Ser) | 137854461 | FBN1 | [ ] | [ ] | ['Marfan syndrome'] |
| NM_000138.4 (FBN1):c.2261A>G (p.Tyr754Cys) | 137854479 | FBN1 | [ ] | [ ] | ['Marfan syndrome'] |
| NM_212482.1 (FN1):c.2918A>G (p.Tyr973Cys) | 137854488 | FN1 | ['GAAGTAA YAGGTGAC CCCAGGGG'] | ['GAAGTAAYAGG TGACCCCAGGGG'] | ['Glomerulopathy with fibronectin deposits 2'] |
| NM_198994.2 (TGM6):c.980A>G (p.Asp327Gly) | 387907098 | TGM6 | [ ] | [ ] | ['Spinocerebellar ataxia 35'] |
| NM_001363.4 (DKC1):c.1069A>G (p.Thr357Ala) | 137854492 | DKC1 | ['GCAGGYA GAGATGAC CGCTGTGG'] | ['GCAGGYAGAGA TGACCGCTGTGG'] | ['Dyskeratosis congenita X-linked'] |
| NM_052873.2 (IFT43):c.1A>G (p.Met1Val) | 387907107 | IFT43 | [ ] | [ ] | ['Cranioectodermal dysplasia 3'] |
| NM_201269.2 (ZNF644):c.2014A>G (p.Ser672Gly) | 387907109 | ZNF644 | [ ] | [ ] | ['Myopia 21, autosomal dominant'] |
| NM_018699.3 (PRDM5):c.320A>G (p.Tyr107Cys) | 387907111 | PRDM5 | [ ] | [ ] | ['Brittle cornea syndrome 2'] |
| NM_000132.3 (F8):c.5822A>G (p.Asn1941Ser) | 28933682 | F8 | [ ] | ['TAGCCAYTGATT GCTGGAGAAGG'] | ['Hereditary factor VIII deficiency disease'] |
| NM_016464.4 (TMEM138):c.287A>G (p.His96Arg) | 387907132 | TMEM138 | ['GACAYGA AGGGAGAT GCTGAGGG'] | ['GACAYGAAGGG AGATGCTGAGGG', 'AGACAYGAAGGG AGATGCTGAGG'] | ['Joubert syndrome 16'] |
| NM_016464.4 (TMEM138):c.389A>G (p.Tyr130Cys) | 387907135 | TMEM138 | [ ] | ['CAGYACAACAC TGCTGCTGTGGG', 'GCAGYACAACAC TGCTGCTGTGG'] | ['Joubert syndrome 16'] |
| NM_177965.3 (C8orf37):c.545A>G (p.Gln182Arg) | 387907137 | C8orf37 | [ ] | [ ] | ['Retinitis pigmentosa 64'] |
| NM_001077488.3 (GNAS):c.1A>G (p.Met1Val) | 137854530 | GNAS | [ ] | ['GCCCAYGGCGG CGGCGGCGGCGG'] | ['Pseudohypoparathyroidism type 1A'] |
| NM_006920.4 (SCN1A):c.2557-2A>G | 727504140 | SCN1A | [ ] | [ ] | ['Severe myoclonic epilepsy in infancy', |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_000308.2 (CTSA):c.200A>G (p.Gln67Arg) | 137854541 | CTSA | [ ] | [ ] | ['Generalized epilepsy with febrile seizures plus, type 2'] ['Combined deficiency of sialidase AND beta galactosidase'] |
| NM_000308.2 (CTSA):c.1238A>G (p.Tyr413Cys) | 137854543 | CTSA | [ ] | [ ] | ['Combined deficiency of sialidase AND beta galactosidase'] |
| NM_000308.2 (CTSA):c.1411A>G (p.Lys471Glu) | 137854549 | CTSA | [ ] | [ ] | ['Galactosialidosis, late infantile'] |
| NM_000267.3 (NF1):c.4267A>G (p.Lys1423Glu) | 137854550 | NF1 | [ ] | [ ] | ['Neurofibromatosis, type 1'] |
| NM_000267.3 (NF1):c.1466A>G (p.Tyr489Cys) | 137854557 | NF1 | ['ACTTAYAGCTTCTTGTCTCCAGG'] | ['ACTTAYAGCTTCTTGTCTCCAGG'] | ['Neurofibromatosis, type 1'] |
| NM_018105.2 (THAP1):c.70A>G (p.Lys24Glu) | 387907176 | THAP1 | [ ] | ['CCTCACTYGTGGAAAGAAACGGG'] | ['Dystonia 6, torsion'] |
| NM_000492.3 (CFTR):c.1393-2A>G | 397508201 | CFTR | [ ] | [ ] | ['Cystic fibrosis'] |
| NM_001172646.1 (PLCB4):c.986A>G (p.Asn329Ser) | 387907179 | PLCB4 | [ ] | [ ] | ['Auriculocondylar syndrome 2'] |
| NM_005850.4 (SF3B4):c.1A>G (p.Met1Val) | 387907185 | SF3B4 | [ ] | [ ] | ['Nager syndrome'] |
| NM_014714.3 (IFT140):c.932A>G (p.Tyr311Cys) | 387907193 | IFT140 | [ ] | [ ] | ['Renal dysplasia, retinal pigmentary dystrophy, cerebellar ataxia and skeletal dysplasia'] |
| NM_005006.6 (NDUFS1):c.1783A>G (p.Thr595Ala) | 387907199 | NDUFS1 | [ ] | [ ] | ['Mitochondrial complex I deficiency'] |
| NM_000397.3 (CYBB):c.1499A>G (p.Asp500Gly) | 137854593 | CYBB | [ ] | ['TCACAYCTTTCTCCTCATCATGG'] | ['Chronic granulomatous disease, X-linked', 'not provided'] |
| NM_033360.3 (KRAS):c.439A>G (p.Lys147Glu) | 387907206 | KRAS | [ ] | [ ] | ['Cardiofaciocutaneous syndrome 2'] |
| NM_000335.4 (SCN5A):c.5381A>G (p.Tyr1794Cys) | 137854614 | SCN5A | [ ] | [ ] | ['Long QT syndrome 3', 'Congenital long QT syndrome'] |
| NM_000076.2 (CDKN1C):c.832A>G (p.Lys278Glu) | 387907226 | CDKN1C | [ ] | ['CGCTYGGCGAAGAAATCTGCGGG', 'GCGCTYGGCGAAGAAATCTGCGG'] | ['Intrauterine growth retardation, metaphyseal dysplasia, adrenal hypoplasia congenita, and genital anomalies'] |
| NM_022912.2 (REEP1):c.304-2A>G | 387907242 | REEP1 | [ ] | ['TCCYGTCAAAGGAAAAACAGAGG'] | ['Distal hereditary motor neuronopathy type 5B'] |
| NM_198253.2 (TERT):c.2705A>G (p.Lys902Arg) | 387907250 | TERT | [ ] | [ ] | ['PULMONARY FIBROSIS AND/OR BONE MARROW FAILURE, TELOMERE-RELATED, 1'] |
| NM_005349.3 (RBPJ):c.188A>G (p.Glu63Gly) | 387907270 | RBPJ | [ ] | [ ] | ['Adams-Oliver syndrome 3'] |

TABLE 8-continued

Human gene mutations that may be corrected by changing a guanine (G) to an adenine (A). The gene name, gene symbol, and dbSNP database reference number (RS#) are indicated. Also indicated are exemplary protospacers with their PAM sequences (gRNAs and gRNAall) and the base to be edited e.g., a C, indicated by a "Y". The "gRNAs" sequences, from top to bottom, correspond to SEQ ID NOs: 3334-3501. The "gRNA all" sequences, from top to bottom, correspond to SEQ ID NOs: 3502-4119.

| Name | RS# (dbSNP) | GeneSymbol | gRNAs | gRNAall | Phenotypes |
|---|---|---|---|---|---|
| NM_005349.3 (RBPJ):c.505A>G (p.Lys169Glu) | 387907271 | RBPJ | [ ] | [ ] | ['Adams-Oliver syndrome 3'] |
| NM_022787.3 (NMNAT1):c.817A>G (p.Asn273Asp) | 387907291 | NMNAT1 | [ ] | ['TGTYTCTCTGCA AAGGGGCCAGG'] | ['Leber congenital amaurosis 9'] |
| NM_000492.3 (CFTR):c.1A>G (p.Met1Val) | 397508328 | CFTR | ['TGCAYGG TCTCTCGG GCGCTGGG'] | ['GCAYGGTCTCTC GGGCGCTGGGG', 'TGCAYGGTCTCT CGGGCGCTGGG', 'CTGCAYGGTCTC TCGGGCGCTGG'] | ['Cystic fibrosis'] |
| NM_020921.3 (NIN):c.5126A>G (p.Asn1709Ser) | 387907308 | NIN | [ ] | [ ] | ['Seckel syndrome 7'] |
| NM_021629.3 (GNB4):c.265A>G (p.Lys89Glu) | 387907341 | GNB4 | [ ] | [ ] | ['Charcot-Marie-Tooth disease, dominant intermediate F'] |
| NM_000355.3 (TCN2):c.580+624A>T | 372866837 | TCN2 | [ ] | [ ] | [ ] |
| NM_032415.5 (CARD11):c.401A>G (p.Glu134Gly) | 387907351 | CARD11 | [ ] | [ ] | ['B-CELL EXPANSION WITH NFKB AND T-CELL ANERGY'] |
| NM_005430.3 (WNT1):c.624+4A>G | 387907354 | WNT1 | [ ] | [ ] | ['Osteogenesis imperfecta type 15'] |
| NM_207352.3 (CYP4V2):c.367A>G (p.Met123Val) | 149684063 | CYP4V2 | [ ] | [ ] | ['Bietti crystalline corneoretinal dystrophy', 'not provided'] |
| NM_031885.3 (BBS2):c.472-2A>G | 137854887 | BBS2 | [ ] | [ ] | ['Bardet-Biedl syndrome 2'] |
| NM_015268.3(DNAJC13):c.2564A>G (p.Asn855Ser) | 387907571 | DNAJC13 | [ ] | [ ] | ['Parkinson disease, late-onset', 'Essential tremor', 'PARKINSON DISEASE 21'] |
| NM_001287.5 (CLCN7):c.296A>G (p.Tyr99Cys) | 387907576 | CLCN7 | [ ] | ['TGTCAYAGTCCA AGCTCTGCAGG'] | ['Osteopetrosis autosomal dominant type 2', 'Osteopetrosis autosomal recessive 4'] |

REFERENCES

1. Humbert O, Davis L, Maizels N. Targeted gene therapies: tools, applications, optimization. *Crit Rev Biochem Mol.* 2012; 47(3):264-81. PMID: 22530743.
2. Perez-Pinera P, Ousterout D G, Gersbach C A. Advances in targeted genome editing. *Curr Opin Chem Biol.* 2012; 16(3-4):268-77. PMID: 22819644.
3. Urnov F D, Rebar E J, Holmes M C, Zhang H S, Gregory P D. Genome editing with engineered zinc finger nucleases. *Nat Rev Genet.* 2010; 11(9):636-46. PMID: 20717154.
4. Joung J K, Sander J D. TALENs: a widely applicable technology for targeted genome editing. *Nat Rev Mol Cell Biol.* 2013; 14(1):49-55. PMID: 23169466.
5. Charpentier E, Doudna J A. Biotechnology: Rewriting a genome. *Nature.* 2013; 495, (7439):50-1. PMID: 23467164.
6. Pan Y, Xia L, Li A S, Zhang X, Sirois P, Zhang J, Li K. Biological and biomedical applications of engineered nucleases. *Mol Biotechnol.* 2013; 55(1):54-62. PMID: 23089945.
7. De Souza, N. Primer: genome editing with engineered nucleases. *Nat Methods.* 2012; 9(1):27. PMID: 22312638.
8. Santiago Y, Chan E, Liu PQ, Orlando S, Zhang L, Urnov F D, Holmes M C, Guschin D, Waite A, Miller J C, Rebar E J, Gregory P D, Klug A, Collingwood T N. Targeted gene knockout in mammalian cells by using engineered zinc-finger nucleases. *Proc Natl Acad Sci USA.* 2008; 105(15):5809-14. PMID: 18359850.
9. Cargill M, Altshuler D, Ireland J, Sklar P, Ardlie K, Patil N, Lane C R, Lim E P, Kalyanaraman N, Nemesh J, Ziaugra L, Friedland L, Rolfe A, Warrington J, Lipshutz R, Daley G Q, Lander E S. Characterization of single-nucleotide polymorphisms in coding regions of human genes. *Nat Genet.* 1999; 22(3):231-8. PMID: 10391209.

10. Jansen R, van Embden J D, Gaastra W, Schouls L M. Identification of genes that are associated with DNA repeats in prokaryotes. *Mol Microbiol.* 2002; 43(6):1565-75. PMID: 11952905.
11. Mali P, Esvelt K M, Church G M. Cas9 as a versatile tool for engineering biology. *Nat Methods.* 2013; 10(10):957-63. PMID: 24076990.
12. Jore M M, Lundgren M, van Duijin E, Bultema J B, Westra E R, Waghmare S P, Wiedenheft B, Pul U, Wurm R, Wagner R, Beijer M R, Barendregt A, Shou K, Snijders A P, Dickman M J, Doudna J A, Boekema E J, Heck A J, van der Oost J, Brouns S J. Structural basis for CRISPR RNA-guided DNA recognition by Cascade. *Nat Struct Mol Biol.* 2011; 18(5):529-36. PMID: 21460843.
13. Horvath P, Barrangou R. CRISPR/Cas, the immune system of bacteria and archaea. *Science.* 2010; 327(5962): 167-70. PMID: 20056882.
14. Wiedenheft B, Sternberg S H, Doudna J A. RNA-guided genetic silencing systems in bacteria and archaea. *Nature.* 2012; 482(7385):331-8. PMID: 22337052.
15. Gasiunas G, Siksnys V. RNA-dependent DNA endonuclease Cas9 of the CRISPR system: Holy Grail of genome editing? *Trends Microbiol.* 2013; 21(11):562-7. PMID: 24095303.
16. Qi L S, Larson M H, Gilbert L A, Doudna J A, Weissman J S, Arkin A P, Lim W A. Repurposing CRISPR as an RNA-guided platform for sequence-specific control of gene expression. *Cell.* 2013; 152(5):1173-83. PMID: 23452860.
17. Perez-Pinera P, Kocak D D, Vockley C M, Adler A F, Kabadi A M, Polstein L R, Thakore P I, Glass K A, Ousterout D G, Leong K W, Guilak F, Crawford G E, Reddy T E, Gersbach C A. RNA-guided gene activation by CRISPR-Cas9-based transcription factors. *Nat Methods.* 2013; 10(10):973-6. PMID: 23892895.
18. Mali P, Aach J, Stranges P B, Esvelt K M, Moosburner M, Kosuri S, Yang L, Church G M. CAS9 transcriptional activators for target specificity screening and paired nickases for cooperative genome engineering. *Nat Biotechnol.* 2013; 31(9):833-8. PMID: 23907171.
19. Gilbert L A, Larson M H, Morsut L, Liu Z, Brar G A, Torres S E, Stern-Ginossar N, Brandman O, Whitehead E H, Doudna J A, Lim W A, Weissman J S, Qi LS. CRISPR-mediated modular RNA-guided regulation of transcription in eukaryotes. *Cell.* 2013; 154(2):442-51. PMID: 23849981.
20. Larson M H, Gilbert L A, Wang X, Lim W A, Weissman J S, Qi L S. CRISPR interference (CRISPRi) for sequence-specific control of gene expression. *Nat Protoc.* 2013; 8(11):2180-96. PMID: 24136345.
21. Mali P, Yang L, Esvelt K M, Aach J, Guell M, DiCarlo J E, Norville J E, Church G M. RNA-guided human genome engineering via Cas9. *Science.* 2013; 339(6121): 823-6. PMID: 23287722.
22. Cole-Strauss A, Yoon K, Xiang Y, Byrne B C, Rice M C, Gryn J, Holloman W K, Kmiec E B. Correction of the mutation responsible for sickle cell anemia by an RNA-DNA oligonucleotide. *Science.* 1996; 273(5280):1386-9. PMID: 8703073.
23. Tagalakis A D, Owen J S, Simons J P. Lack of RNA-DNA oligonucleotide (chimeraplast) mutagenic activity in mouse embryos. *Mol Reprod Dev.* 2005; 71(2):140-4. PMID: 15791601.
24. Ray A, Langer M. Homologous recombination: ends as the means. *Trends Plant Sci.* 2002; 7(10):435-40. PMID 12399177.
25. Britt A B, May G D. Re-engineering plant gene targeting. *Trends Plant Sci.* 2003; 8(2):90-5. PMID: 12597876.
26. Vagner V, Ehrlich S D. Efficiency of homologous DNA recombination varies along the *Bacillus subtilis* chromosome. *J Bacteriol.* 1988; 170(9):3978-82. PMID: 3137211.
27. Saleh-Gohari N, Helleday T. Conservative homologous recombination preferentially repairs DNA double-strand breaks in the S phase of the cell cycle in human cells. *Nucleic Acids Res.* 2004; 32(12):3683-8. PMID: 15252152.
28. Lombardo A, Genovese P, Beausejour C M, Colleoni S, Lee Y L, Kim K A, Ando D, Urnov F D, Galli C, Gregory P D, Holmes M C, Naldini L. Gene editing in human stem cells using zinc finger nucleases and integrase-defective lentiviral vector delivery. *Nat Biotechnol.* 2007; 25(11): 1298-306. PMID: 17965707.
29. Conticello S G. The AID/APOBEC family of nucleic acid mutators. *Genome Biol.* 2008; 9(6):229. PMID: 18598372.
30. Reynaud C A, Aoufouchi S, Faili A, Weill J C. What role for AID: mutator, or assembler of the immunoglobulin mutasome? *Nat Immunol.* 2003; 4(7):631-8.
31. Bhagwat A S. DNA-cytosine deaminases: from antibody maturation to antiviral defense. *DNA Repair (Amst).* 2004; 3(1):85-9. PMID: 14697763.
32. Navaratnam N, Sarwar R. An overview of cytidine deaminases. *Int J Hematol.* 2006; 83(3):195-200. PMID: 16720547.
33. Holden L G, Prochnow C, Chang Y P, Bransteitter R, Chelico L, Sen U, Stevens R C, Goodman M F, Chen X S. Crystal structure of the anti-viral APOBEC3G catalytic domain and functional implications. *Nature.* 2008; 456 (7218):121-4. PMID: 18849968.
34. Chelico L, Pham P, Petruska J, Goodman M F. Biochemical basis of immunological and retroviral responses to DNA-targeted cytosine deamination by activation-induced cytidine deaminase and APOBEC3G. *J Biol Chem.* 2009; 284(41). 27761-5. PMID: 19684020.
35. Pham P, Bransteitter R, Goodman M F. Reward versus risk: DNA cytidine deaminases triggering immunity and disease. *Biochemistry.* 2005; 44(8):2703-15. PMID 15723516.
36. Chen X, Zaro J L, Shen W C. Fusion protein linkers: property, design and functionality. *Adv Drug Deliv Rev.* 2013; 65(10):1357-69. PMID: 23026637.
37. Lee J W, Soung Y H, Kim S Y, Lee H W, Park W S, Nam S W, Kim S H, Lee J Y, Yoo N J, Lee S H. PIK3CA gene is frequently mutated in breast carcinomas and hepatocellular carcinomas. *Oncogene.* 2005; 24(8):1477-80. PMID: 15608678.
38. Ikediobi O N, Davies H, Bignell G, Edkins S, Stevens C, O'Meara S, Santarius T, Avis T, Barthorpe S, Brackenbury L, Buck G, Butler A, Clements J, Cole J, Dicks E, Forbes S, Gray K, Halliday K, Harrison R, Hills K, Hinton J, Hunter C, Jenkinson A, Jones D, Kosmidou V, Lugg R, Menzies A, Mironenko T, Parker A, Perry J, Raine K, Richardson D, Shepherd R, Small A, Smith R, Solomon H, Stephens P, Teague J, Tofts C, Varian J, Webb T, West S, Widaa S, Yates A, Reinhold W, Weinstein J N, Stratton M R, Futreal P A, Wooster R. Mutation analysis of 24 known cancer genes in the NCI-60 cell line set. *Mol Cancer Ther.* 2006; 5(11):2606-12. PMID: 17088437.
39. Cox, D. B., Platt, R. J. & Zhang, F. Therapeutic genome editing: prospects and challenges. *Nature medicine* 21,121-131, doi:10.1038/nm.3793 (2015).

40. Hilton, I. B. & Gersbach, C. A. Enabling functional genomics with genome engineering. *Genome research* 25,1442-1455, doi:10.1101/gr.190124.115 (2015).
41. Sander, J. D. & Joung, J. K. CRISPR-Cas systems for editing, regulating and targeting genomes. *Nature biotechnology* 32,347-355, doi:10.1038/nbt.2842 (2014).
42. Maruyama, T. et al. Increasing the efficiency of precise genome editing with CRISPR-Cas9 by inhibition of non-homologous end joining. *Nature biotechnology* 33,538-542, doi:10.1038/nbt.3190 (2015).
43. Chu, V. T. et al. Increasing the efficiency of homology-directed repair for CRISPR-Cas9-induced precise gene editing in mammalian cells. *Nature biotechnology* 33, 543-548, doi:10.1038/nbt.3198 (2015).
44. Lin, S., Staahl, B. T., Alla, R. K. & Doudna, J. A. Enhanced homology-directed human genome engineering by controlled timing of CRISPR/Cas9 delivery. *eLife* 3, e04766, doi:10.7554/eLife.04766 (2014).
45. Cong, L. et al. Multiplex genome engineering using CRISPR/Cas systems. *Science* 339,819-823, doi:10.1126/science.1231143 (2013).
46. Rong, Z., Zhu, S., Xu, Y. & Fu, X. Homologous recombination in human embryonic stem cells using CRISPR/Cas9 nickase and a long DNA donor template. *Protein & cell* 5, 258-260, doi:10.1007/s13238-014-0032-5 (2014).
47. Jinek, M. et al. A Programmable Dual-RNA-Guided DNA Endonuclease in Adaptive Bacterial Immunity. *Science* 337, 816-821, doi:10.1126/science.1225829 (2012).
48. Harris, R. S., Petersen-Mahrt, S. K. & Neuberger, M. S. RNA Editing Enzyme APOBEC1 and Some of Its Homologs Can Act as DNA Mutators. *Molecular Cell* 10, 1247-1253 (2002).
49. Jinek, M. et al. Structures of Cas9 endonucleases reveal RNA-mediated conformational activation. *Science* 343, 1247997, doi:10.1126/science.1247997 (2014).
50. Schellenberger, V. et al. A recombinant polypeptide extends the in vivo half-life of peptides and proteins in a tunable manner. *Nature biotechnology* 27, 1186-1190, doi:10.1038/nbt.1588 (2009).
51. Saraconi, G., Severi, F., Sala, C., Mattiuz, G. & Conticello, S. G. The RNA editing enzyme APOBEC1 induces somatic mutations and a compatible mutational signature is present in esophageal adenocarcinomas. *Genome biology* 15, 417-(2014).
52. Anders, C., Niewoehner, O., Duerst, A. & Jinek, M. Structural basis of PAM-dependent target DNA recognition by the Cas9 endonuclease. *Nature* 513, 569-573, doi:10.1038/nature13579 (2014).
53. Cong, L. et al. Multiplex genome engineering using CRISPR/Cas systems. *Science* 339, 819-823 (2013).
54. Tsai, S. Q. et al. GUIDE-seq enables genome-wide profiling of off-target cleavage by CRISPR-Cas nucleases. *Nature biotechnology* 33, 187-197, doi:10.1038/nbt.3117 (2015).
55. Kunz, C., Saito, Y. & Schar, P. DNA Repair in mammalian cells: Mismatched repair: variations on a theme. *Cellular and molecular life sciences: CMLS* 66, 1021-1038, doi:10.1007/s00018-009-8739-9 (2009).
56. D., M. C. et al. Crystal structure of human uracil-DNA glycosylase in complex with a protein inhibitor: protein mimicry of DNA. *Cell* 82, 701-708 (1995).
57. Caldecott, K. W. Single-strand break repair and genetic disease. *Nature reviews. Genetics* 9, 619-631, doi: 10.1038/nrg2380 (2008).
58. Fukui, K. DNA mismatch repair in eukaryotes and bacteria. *Journal of nucleic acids* 2010, doi:10.4061/2010/260512 (2010).
59. Gasiunas, G., Barrangou, R., Horvath, P. & Siksnys, V. Cas9-crRNA ribonucleoprotein complex mediates specific DNA cleavage for adaptive immunity in bacteria. *Proceedings of the National Academy of Sciences* 109, E2579-E2586, doi:10.1073/pnas.1208507109 (2012).
60. Ran, F. A. et al. In vivo genome editing using Staphylococcus aureus Cas9. *Nature* 520, 186-191, doi:10.1038/nature14299 (2015).
61. Kuscu, C., Arslan, S., Singh, R., Thorpe, J. & Adli, M. Genome-wide analysis reveals characteristics of off-target sites bound by the Cas9 endonuclease. *Nature biotechnology* 32, 677-683, doi:10.1038/nbt.2916 (2014).
62. Wu, X. et al. Genome-wide binding of the CRISPR endonuclease Cas9 in mammalian cells. *Nature biotechnology* 32, 670-676, doi:10.1038/nbt.2889 (2014).
63. Beale, R. C. L. et al. Comparison of the Differential Context-dependence of DNA Deamination by APOBEC Enzymes: Correlation with Mutation Spectra in Vivo. *Journal of Molecular Biology* 337, 585-596, doi:10.1016/j.jmb.2004.01.046 (2004).
64. Kim, J., Basak, J. M. & Holtzman, D. M. The role of apolipoprotein E in Alzheimer's disease. *Neuron* 63, 287-303, doi:10.1016/j.neuron.2009.06.026 (2009).
65. Liu, C. C., Kanekiyo, T., Xu, H. & Bu, G. Apolipoprotein E and Alzheimer disease: risk, mechanisms and therapy. *Nature reviews. Neurology* 9, 106-118, doi:10.1038/nrneurol.2012.263 (2013).
66. Sjöblom, T. et al. The Consensus Coding Sequences of Human Breast and Colorectal Cancers. *Science* 314, 268-274, doi:10.1126/science.1133427 (2006).
67. Stephens, P. J. et al. The landscape of cancer genes and mutational processes in breast cancer. *Nature* 486, 400-404, doi:10.1038/nature11017 (2012).
68. Landrum, M. J. et al. ClinVar: public archive of interpretations of clinically relevant variants. *Nucleic Acids Research, doi:*10.1093/nar/gkv1222 (2015).
69. Slaymaker, I. M. et al. Rationally engineered Cas9 nucleases with improved specificity. *Science, doi:* 10.1126/science.aad5227 (2015).
70. Davis, K. M., Pattanayak, V., Thompson, D. B., Zuris, J. A. & Liu, D. R. Small molecule-triggered Cas9 protein with improved genome-editing specificity. *Nature chemical biology* 11, 316-318, doi:10.1038/nchembio.1793 (2015).
71. Zuris, J. A. et al. Cationic lipid-mediated delivery of proteins enables efficient protein-based genome editing in vitro and in vivo. *Nature biotechnology* 33, 73-80, doi: 10.1038/nbt.3081 (2015).
72. Kleinstiver, B. P. et al. Engineered CRISPR-Cas9 nucleases with altered PAM specificities. *Nature* 523, 481-485, doi:10.1038/nature14592 (2015).
73. Pattanayak, V. et al. High-throughput profiling of off-target DNA cleavage reveals RNA-programmed Cas9 nuclease specificity. *Nature Biotechnology* 31, 839-843, doi:10.1038/nbt.2673 (2013).
74. Shcherbakova, D. M. & Verkhusha, V. V. Near-infrared fluorescent proteins for multicolor in vivo imaging. *Nature Methods* 10, 751-754, doi:10.1038/nmeth.2521 (2013).
75. Ran, F. A. et al. Genome engineering using the CRISPR-Cas9 system. *Nat. Protocols* 8, 2281-2308, doi:10.1038/nprot.2013.143 (2013).

76. Jiang, F. et al. Structures of a CRISPR-Cas9 R-loop complex primed for DNA cleavage. *Science,* doi:10.1126/science.aad8282 (2016).
77. Tsai, S. Q. et al. Dimeric CRISPR RNA-guided FokI nucleases for highly specific genome editing. *Nat Biotech* 32, 569-576, doi:10.1038/nbt.2908 (2014).
78. Lieber, M. R., Ma, Y., Pannicke, U. & Schwarz, K. Mechanism and regulation of human non-homologous DNA end-joining. *Nat Rev Mol Cell Biol* 4, 712-720 (2003).
79. Heller, R. C. & Marians, K. J. Replisome assembly and the direct restart of stalled replication forks. *Nat Rev Mol Cell Biol* 7, 932-943 (2006).
80. Pluciennik, A. et al. PCNA function in the activation and strand direction of MutLα endonuclease in mismatch repair. *Proceedings of the National Academy of Sciences of the United States of America* 107, 16066-16071, doi: 10.1073/pnas.1010662107 (2010).
81. Seripa, D. et al. The missing ApoE allele. *Annals of human genetics* 71, 496-500, doi:10.1111/j.1469-1809.2006.00344.x (2007).
82. Kleinstiver, B. P. et al. High-fidelity CRISPR-Cas9 nucleases with no detectable genome-wide off-target effects. *Nature* 529, 490-495, doi:10.1038/nature16526 (2016).
83. Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. *Nat Biotech* 34, 339-344, doi:10.1038/nbt.3481 (2016).
84. Simonelli, V., Narciso, L., Dogliotti, E. & Fortini, P. Base excision repair intermediates are mutagenic in mammalian cells. *Nucleic acids research* 33, 4404-4411, doi: 10.1093/nar/gki749 (2005).
85. Barnes, D. E. & Lindahl, T. Repair and Genetic Consequences of Endogenous DNA Base Damage in Mammalian Cells. *Annual Review of Genetics* 38, 445-476, doi: doi:10.1146/annurev.genet.38.072902.092448 (2004).

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the invention encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

SEQUENCE LISTING (5808 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 4 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 5 aa, Artificial Sequence
  Synthetic Polypeptide
GGGGS

SEQ ID NO: 6 - protein, 5 aa, Artificial Sequence
  Synthetic Polypeptide
EAAAK

SEQ ID NO: 7 - protein, 16 aa, Artificial Sequence
  Synthetic Polypeptide
SGSETPGTSESATPES

SEQ ID NO: 8 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 9 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 10 - protein, 1368 aa, Streptococcus pyogenes [sequence omitted]

SEQ ID NO: 11 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 12 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 13 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 14 - protein, 986 aa, Staphylococcus Aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 15 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 16 - protein, 1359 aa, Streptococcus pyogenes; identical to SEQ ID NO: 11

SEQ ID NO: 17 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 19 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 21 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 22 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 23 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 24 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 25 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 26 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 27 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 29 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 30 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 31 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 34 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 37 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 38 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 536 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 305 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1359 aa, Artificial Sequence
  Synthetic Polypeptide
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1341 aa, Artificial Sequence
  Synthetic Polypeptide
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 43 - protein, 1356 aa, Artificial Sequence
  Synthetic Polypeptide
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 44 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 45 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 46 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 47 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 48 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 49 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 50 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 51 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 52 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 53 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 54 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 55 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 56 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 57 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 58 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 59 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 60 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 61 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 62 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 63 - protein, 1365 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 67 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 68 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 69 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 70 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 71 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 72 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 73 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 74 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 75 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 76 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 77 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 78 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 80 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 81 - protein, 1365 aa, Streptococcus agalactiae; identical to SEQ ID NO: 50

SEQ ID NO: 82 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 84 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 85 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 86 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 87 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 88 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 89 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 90 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 91 - protein, 1365 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1365 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 93 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 94 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 95 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 96 - protein, 1341 aa, Streptococcus anginosus; identical to SEQ ID NO: 94

SEQ ID NO: 97 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 98 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 99 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 100 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 101 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 102 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 103 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 104 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 105 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 107 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 108 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 109 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 110 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 111 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 112 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 113 - protein, 1355 aa, Streptococcus gallolyticus; identical to SEQ ID NO: 12

SEQ ID NO: 114 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 115 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 116 - protein, 1263 aa, Streptococcus iniae
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 117 - protein, 1257 aa, Streptococcus iniae
  misc_feature (1255)..(1255): Xaa can be any naturally occurring amino acid
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 118 - protein, 199 aa, Streptococcus iniae
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 119 - protein, 1271 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 120 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 121 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 122 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 123 - protein, 1359 aa, Streptococcus mitis; identical to SEQ ID NO: 13

SEQ ID NO: 124 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 125 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 126 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 127 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 128 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 129 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 130 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 131 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 132 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 133 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 134 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 135 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 136 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 137 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 140 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 141 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 142 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 143 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 145 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 146 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 147 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 148 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 149 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 150 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 151 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 152 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 153 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 154 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 155 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 156 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 157 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 158 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 159 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 160 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 161 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 162 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 163 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 166 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 168 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 169 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 170 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 171 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 172 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 173 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 174 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 175 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 176 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 177 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 178 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 179 - protein, 1316 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 180 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 181 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 182 - protein, 1360 aa, Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 183 - protein, 1360 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 184 - protein, 1364 aa, Streptococcus sp. M334
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 185 - protein, 1360 aa, Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 186 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 187 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 188 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 189 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 190 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 191 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 192 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 193 - protein, 1359 aa, Artificial Sequence; identical to SEQ ID NO: 11
  Synthetic Polypeptide

SEQ ID NO: 194 - protein, 1317 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 195 - protein, 1359 aa, Artificial Sequence; identical to SEQ ID NO: 11
  Synthetic Polypeptide

SEQ ID NO: 196 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 197 - protein, 1329 aa, Artificial Sequence
  Synthetic Polypeptide
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 198 - protein, 1280 aa, Artificial Sequence
  Synthetic Polypeptide
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 199 - protein, 1072 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 200 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 201 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 202 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 203 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 204 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 205 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 206 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 207 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 208 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 209 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 210 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 211 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 212 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 213 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 214 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 215 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 216 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 217 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 218 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 219 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 220 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 221 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 222 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 223 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 224 - protein, 1323 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSTLLDDPDMTTMFEEIIKILTIFEDREMIREQLKPYETVLGLPAIKKLAKKHYTGWGRLSEKMIQGMREKQSRKTILDYLIDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGER

SEQ ID NO: 225 - protein, 1330 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 226 - protein, 1327 aa, Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLIDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 227 - protein, 1332 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYELLEQPEMEEMFEDIVKIITIFEDREMVRTQLKKYQRILGEEIFKKLVKKKYTGWGRLSKRLINGIRDQKTNKTILDYLIDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 228 - protein, 1359 aa, Artificial Sequence
  Synthetic Polypeptide
ADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 229 - protein, 1300 aa, Kandleria vitulina
NNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNKNKDKKDGFILNSMRNLYADKDTGEVVWDPEWISRIKKCFYYKDCFVTKKLEENNGSFFNTVRPNDEHSEKGAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSEIVNARQLILDFNCTRIIDGIYKAMKYKNYSELSQEEIMNVYDIFVEKLKLYYPTYKNIATNFENFENISDEEKCEVIQMLVVMHAGPQNGNITFDDFKLSNRLGRLNCKTISLTTVFIADSPTGMYSKKYKL

SEQ ID NO: 230 - protein, 1301 aa, Kandleria vitulina
NNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRQKNKGKNDGFILNSMRNIYADKDTGEIVWDPNYIDRIKKCFYYKDCFVTKKLEENNGTFFNTVLPNDTNSDKDATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAEIINAKQLILNESQTKLVCEIYKAMKYKNYDNLDSEKIIDLYRLLINKMELYYPEYRKQLVKKFEDLKVISIEEKCNIIQILATLHCNSSIGKIMYSDFKISTTIGRLNGRTISLDISFIAESPTGMYSKKYKL

SEQ ID NO: 231 - protein, 1304 aa, Lactobacillus animalis
LKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMEDYSQNFMQLINDDTYSFKETIKNAQVIEKEETLAKTVQELPGSPAIKKGILQSLEIVDEIIKVMGYKPKSIVVEMARETQTHGTRKREDRVQQIVKNLKELPKPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 232 - protein, 1292 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKQTSLFNDRTDRAFYDDYPTIYHLRYKLMTEKRQFDIREIYLAMHHIVKYRGHFLNEAPVSSFKSSEINLVAHFDRLNTIFADLFSESGFTDKLAEVKALLLDNHQSASNRQRQALLLIYTPSKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGKSKEDFYGDITKALKNNPDHPIVSEIKKLIELDQFMPKQRTKDNGAIPHQLHQQELDRIIENQQQYYPWLAELNPNKLDELVAFRVPYYVGPLQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISELEIRNELKDLSNSALSNTRLFLYFMQGGRDMYTGDSLNIDRLSTYDIDHILPQSFIKDNSLDNRVLVSQRMNRSKADQVPSVELGQKMQIQWEQMLRAGLITKKKYDNLTLNPDMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKRNFNFLNGLKKDELVDENTEAVIWNKESGLAYLNKIYQFKKILVTREVHENSGALFNQTLYAAKDDKASGQLIPAKQDRPTALYGGYSGKTVAYMCIVRIKNKKGDLYKVCGVETSWLAQLKQKKAFLKQKISPQFTKVKKQKGTIVKVVEDFEVIAPHILINQRFFDNGQELTLGSHNEQELILDKTAVKLLNGALPLTQSEELAEQVYDEILDQVMHYFPLYDTNQFRAKLSAGKAADGNKMVQVGQQVILDRVLIGLHANAAVSDLGVLKISTPLGKMQQPSGISDTQIIYQSPTGLFERRVALRDL

SEQ ID NO: 233 - protein, 1291 aa, Lactobacillus farciminis
KEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKKKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNDLMWTTNNNFISIISNDKYDFKNYIENHNLNKNEDQNISNLVNDIHVSPALKRGITQSIKIVQEIVKFMGHAPKYIFIEVTRETKTTSRGKRIQRLQSKLLNKANGLVPEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALELVKNRNINDFHHAQDAYLASFLGTYRLRRFPTDEMLLMNGEYNKFYGKELYSKKSRKNGFIISPLVNGTTQDRNTGEIIWNVGFRDKILKIFNYHQCNVTRKTEIKTGQFYDQTIYSPKNPKKLIAQKKDMDPNIYGGFSGDNKSSITIVKIDNNKIKPVAIPIRLINDKKTLQNWLEENVKHKKSIQIIKNNVPIGQIIYSKKVGLLSREIANRQQLILPPEHSALLRILQIPDEDPDQILAFYDKNILVEILQELITKMKKFYPFYKNEQEFLASFNQATTSEKINSLEELITLLHANSTSAHLIFNNIEKKAFGRKTHGLTDTDFIYQSVTGLYETRIHIE

SEQ ID NO: 234 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 235 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 236 - protein, 1327 aa, Listeria innocua; identical to SEQ ID NO: 235

SEQ ID NO: 237 - protein, 1101 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 238 - protein, 1327 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIERLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 239 - protein, 952 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 240 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 241 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 242 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 243 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 244 - protein, 1327 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 245 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 246 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 247 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 248 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 249 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 250 - protein, 1327 aa, Listeria monocytogenes; identical to SEQ ID NO: 245

SEQ ID NO: 251 - protein, 1327 aa, Listeria monocytogenes; identical to SEQ ID NO: 249

SEQ ID NO: 252 - protein, 781 aa, Listeria monocytogenes
  misc_feature (721)..(721): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 253 - protein, 1327 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIERIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 254 - protein, 1359 aa, Artificial Sequence; identical to SEQ ID NO: 228
  Synthetic Polypeptide

SEQ ID NO: 255 - protein, 1290 aa, Roseburia hominis
IVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDVFTQFADFNNIPYEDDKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRKAPVDEFYKFVKKCIEKVDTPEAKQILHDIELENFLLKQNSRTNGSVPYQMQLDEMIKIIDNQAKYYPVLKEKREQLLSILTFRIPYYFGPLETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADSVTVLDVLESRLNLMEIINDKELGYAQMIEEASSCPKDGKFTYEEVAKLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQMFNTVLPNDAHSAKGAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSECVNAMQLVLNEEQCKLIADIYNAIYKQDFDGLDNMLMIQLYLQLIDKLKTLYPIYMGIVEKFEKFVSISKEEKANVIQMLIIMHKGPQNGNIIYDDFNVGKRIGRLNGRTFYLNIEFISQSPTGIYTKKYKL

SEQ ID NO: 256 - protein, 1292 aa, Sharpea azabuensis
KDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGDNYNLFIEKDFNDKTYYDKYPTIYHLRKELCENKEKADPRLIYLALHHIVKYRGNFLYEGQSFTMDNSDIEERLNSAIEKFMSINEFDNRIVSDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYDTPVEEFYKYIKGLLAKVDTDEAREILERIDLEKFMLKQNSRTNGSIPYQMQKDEMIQIIDNQSVYYPQLKENRDKLISILEFRIPYYFGPLAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADKATVLFVLESNKNLMEIINDEKLGYKQIIEESNMQDIEGPFKYDEVKKLAGSPAIKRGIWQALLVVREITKFMKHEPSHIYIEFAREEQKVRKESKIAKLQKIYENLQTQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKNYGFILNSMNHLQSDIDTGEVMWDPAKIGKIKSCFYYKDVYVTKKLEQNSGTLFNTVLPNDAHSEKGATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSEYVTARQLSLNEQSCKLISEIYAAMLKKRYEYLDEEEIFDLYLQLLQKMDTLYPAYKGIAKRFFDFKNIDVVEKCDVIQILIIMHAGPMNGNIMYDDFKFTNRIGRFTHKNIDLKTTFISTSVTGLFSKKYKL

SEQ ID NO: 257 - protein, 1359 aa, Artificial Sequence; identical to SEQ ID NO: 228
  Synthetic Polypeptide

SEQ ID NO: 258 - protein, 1359 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 259 - protein, 1359 aa, Artificial Sequence; identical to SEQ ID NO: 11
  Synthetic Polypeptide

SEQ ID NO: 260 - protein, 1359 aa, Artificial Sequence; identical to SEQ ID NO: 258
  Synthetic Polypeptide

SEQ ID NO: 261-262 - skipped (2 entries)

SEQ ID NO: 263 - protein, 1368 aa, Artificial Sequence; identical to SEQ ID NO: 9
  Synthetic Polypeptide

SEQ ID NO: 264 - DNA, 20 bp, Artificial Sequence
  Synthetic Polynucleotide
ttatttcgtggatttattta

SEQ ID NO: 265 - protein, 4 aa, Artificial Sequence
  Synthetic Polypeptide
GGGS

SEQ ID NO: 266 - protein, 198 aa, Homo sapiens [sequence omitted]

SEQ ID NO: 267 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 268 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 269 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 270 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 271 - protein, 429 aa, Rattus rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 272 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 273 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 274 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 275 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 276 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 277 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 278 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 279 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 280 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 281 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 282 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 283 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 284 - protein, 229 aa, Rattus rattus [sequence omitted]

SEQ ID NO: 285 - protein, 1612 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 286-292 - skipped (7 entries)

SEQ ID NO: 293 - DNA, 23 bp, Artificial Sequence
  Synthetic Polynucleotide
gagtccgagcagaagaagaaggg

SEQ ID NO: 294 - DNA, 23 bp, Artificial Sequence
  Synthetic Polynucleotide
ggaatcccttctgcagcacctgg

SEQ ID NO: 295 - DNA, 23 bp, Artificial Sequence
  Synthetic Polynucleotide
gaacacaaagcatagactgcggg

SEQ ID NO: 296 - DNA, 23 bp, Artificial Sequence
  Synthetic Polynucleotide
ggcccagactgagcacgtgatgg

SEQ ID NO: 297 - DNA, 23 bp, Artificial Sequence
  Synthetic Polynucleotide
ggcactgcggctggaggtggggg

SEQ ID NO: 298 - DNA, 23 bp, Artificial Sequence
  Synthetic Polynucleotide
gtcatcttagtcattacctgagg

SEQ ID NO: 299 - protein, 7 aa, Artificial Sequence
  Synthetic Polypeptide
  MISC_FEATURE (2)..(2): X is Arginine or Cysteine
KXLAVYQ

SEQ ID NO: 300 - protein, 7 aa, Artificial Sequence
  Synthetic Polypeptide
  MISC_FEATURE (7)..(7): X is Asparagine or Aspartic acid
HYNYMCX

SEQ ID NO: 301 - protein, 7 aa, Artificial Sequence
  Synthetic Polypeptide
  MISC_FEATURE (6)..(6): X is Cysteine or Tyrosine
RAMAIXK

SEQ ID NO: 302 - skipped

SEQ ID NO: 303 - DNA, 23 bp, Artificial Sequence
  Synthetic Polynucleotide
ggaatcccttctgcagcacctgg

SEQ ID NO: 304 - DNA, 20 bp, Artificial Sequence
  Synthetic Polynucleotide
ctcccatcacatcaaccggt

SEQ ID NO: 305 - DNA, 26 bp, Artificial Sequence
  Synthetic Polynucleotide
tttcctcccccccacaggtagaacat

SEQ ID NO: 306 - DNA, 27 bp, Artificial Sequence
  Synthetic Polynucleotide
tttccctctgtccacaccctcatcctg

SEQ ID NO: 307 - DNA, 27 bp, Artificial Sequence
  Synthetic Polynucleotide
tttccccagtcctccacaccctgaaac

SEQ ID NO: 308 - DNA, 20 bp, Artificial Sequence
  Synthetic Polynucleotide
tgcccctccctccctggccc

SEQ ID NO: 309 - DNA, 20 bp, Artificial Sequence
  Synthetic Polynucleotide
agagccccccctcaaagaga

SEQ ID NO: 310 - DNA, 23 bp, Artificial Sequence
  Synthetic Polynucleotide
ggcccagactgagcacgtgatgg

SEQ ID NO: 311 - DNA, 23 bp, Artificial Sequence
  Synthetic Polynucleotide
gagtccgagcagaagaagaaggg

SEQ ID NO: 312 - DNA, 23 bp, Artificial Sequence
  Synthetic Polynucleotide
gaacacaaagcatagactgcggg

SEQ ID NO: 313 - DNA, 21 bp, Artificial Sequence
  Synthetic Polynucleotide
gagtccgagcagaagaagaag

SEQ ID NO: 314 - DNA, 23 bp, Artificial Sequence
  Synthetic Polynucleotide
ggaatcccttctgcagcacctgg

SEQ ID NO: 315 - DNA, 20 bp, Artificial Sequence
  Synthetic Polynucleotide
ggcccagactgagcacgtga

SEQ ID NO: 316 - DNA, 23 bp, Artificial Sequence
  Synthetic Polynucleotide
ggcactgcggctggaggtggggg

SEQ ID NO: 317 - DNA, 20 bp, Artificial Sequence
  Synthetic Polynucleotide
gtcaggtcgagggttctgtc

SEQ ID NO: 318 - DNA, 20 bp, Artificial Sequence
  Synthetic Polynucleotide
gggccgcagtatcctcactc

SEQ ID NO: 319 - DNA, 20 bp, Artificial Sequence
  Synthetic Polynucleotide
ccgccagtcccagtacggga

SEQ ID NO: 320 - DNA, 20 bp, Artificial Sequence
  Synthetic Polynucleotide
caaccactgctcaaagatgc

SEQ ID NO: 321 - DNA, 20 bp, Artificial Sequence
  Synthetic Polynucleotide
cttccaggatgagaacacag

SEQ ID NO: 322 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 323 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 324 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 325 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 326 - skipped

SEQ ID NO: 327 - DNA, 23 bp, Artificial Sequence
  Synthetic Polynucleotide
gaacacaatgcatagattgccgg

SEQ ID NO: 328 - DNA, 23 bp, Artificial Sequence
  Synthetic Polynucleotide
aaacataaagcatagactgcaaa

SEQ ID NO: 329 - DNA, 22 bp, Artificial Sequence
  Synthetic Polynucleotide
ggtgtttcgtcctttccacaag

SEQ ID NO: 330 - DNA, 55 bp, Artificial Sequence
  Synthetic Polynucleotide
gcttgcagatggccatggcggttttagagctagaaatagcaagttaaaataaggc

SEQ ID NO: 331 - DNA, 55 bp, Artificial Sequence
  Synthetic Polynucleotide
tgtcacacatgtagttgtaggttttagagctagaaatagcaagttaaaataaggc

SEQ ID NO: 332 - DNA, 55 bp, Artificial Sequence
  Synthetic Polynucleotide
gaagcgcctggcagtgtaccgttttagagctagaaatagcaagttaaaataaggc

SEQ ID NO: 333 - DNA, 55 bp, Artificial Sequence
  Synthetic Polynucleotide
gagtccgagcagaagaagaagttttagagctagaaatagcaagttaaaataaggc

SEQ ID NO: 334 - DNA, 55 bp, Artificial Sequence
  Synthetic Polynucleotide
ggaatcccttctgcagcaccgttttagagctagaaatagcaagttaaaataaggc

SEQ ID NO: 335 - DNA, 55 bp, Artificial Sequence
  Synthetic Polynucleotide
gaacacaaagcatagactgcgttttagagctagaaatagcaagttaaaataaggc

SEQ ID NO: 336 - DNA, 56 bp, Artificial Sequence
  Synthetic Polynucleotide
ggcccagactgagcacgtagagttttagagctagaaatagcaagttaaaataaggc

SEQ ID NO: 337 - DNA, 55 bp, Artificial Sequence
  Synthetic Polynucleotide
ggcactgcggctggaggtgggttttagagctagaaatagcaagttaaaataaggc

SEQ ID NO: 338 - DNA, 55 bp, Artificial Sequence
  Synthetic Polynucleotide
gtcatcttagtcattacctggttttagagctagaaatagcaagttaaaataaggc

SEQ ID NO: 339 - DNA, 42 bp, Artificial Sequence
  Synthetic Polynucleotide
attattattattccgcggatttatttatttatttatttattt

SEQ ID NO: 340 - DNA, 40 bp, Artificial Sequence
  Synthetic Polynucleotide
attattattattagctatttatttatttatttatttattt

SEQ ID NO: 341 - DNA, 41 bp, Artificial Sequence
  Synthetic Polynucleotide
attattattattcccggatttatttatttatttatttattt

SEQ ID NO: 342 - DNA, 21 bp, Artificial Sequence
  Synthetic Polynucleotide
aaaaaaagcaccgactcggtg

SEQ ID NO: 343 - DNA, 60 bp, Artificial Sequence
  Synthetic Polynucleotide
taatacgactcactataggccgcggatttatttatttaagttttagagctagaaatagca

SEQ ID NO: 344 - DNA, 60 bp, Artificial Sequence
  Synthetic Polynucleotide
taatacgactcactataggtccgcggatttatttatttagttttagagctagaaatagca

SEQ ID NO: 345 - DNA, 60 bp, Artificial Sequence
  Synthetic Polynucleotide
taatacgactcactataggttccgcggatttatttattagttttagagctagaaatagca

SEQ ID NO: 346 - DNA, 60 bp, Artificial Sequence
  Synthetic Polynucleotide
taatacgactcactataggattccgcggatttatttattgttttagagctagaaatagca

SEQ ID NO: 347 - DNA, 61 bp, Artificial Sequence
  Synthetic Polynucleotide
taatacgactcactataggtattccgcggatttatttatgtttttagagctagaaatagca

SEQ ID NO: 348 - DNA, 60 bp, Artificial Sequence
  Synthetic Polynucleotide
taataacgactcactataggttattccgcggatttatttagtttagagctagaaatagca

SEQ ID NO: 349 - DNA, 60 bp, Artificial Sequence
  Synthetic Polynucleotide
taatacgactcactataggattattccgcggatttatttgttttagagctagaaatagca

SEQ ID NO: 350 - DNA, 60 bp, Artificial Sequence
  Synthetic Polynucleotide
taatacgactcactataggtattattccgcggatttattgttttagagctagaaatagca

SEQ ID NO: 351 - DNA, 60 bp, Artificial Sequence
  Synthetic Polynucleotide
taatacgactcactataggattattatccgcggatttatgttttagagctagaaatagca

SEQ ID NO: 352 - DNA, 60 bp, Artificial Sequence
  Synthetic Polynucleotide
taatacgactcactataggtattatattccgcggatttagttttagagctagaaatagca

SEQ ID NO: 353 - DNA, 60 bp, Artificial Sequence
  Synthetic Polynucleotide
taatacgactcactataggttattatattccgcggatttgttttagagctagaaatagca

SEQ ID NO: 354 - DNA, 60 bp, Artificial Sequence
  Synthetic Polynucleotide
taatacgactcactataggattattatattccgcggattgttttagagctagaaatagca

SEQ ID NO: 355 - DNA, 60 bp, Artificial Sequence
  Synthetic Polynucleotide
taatacgactcactataggtattattatattccgcggatgttttagagctagaaatagca

SEQ ID NO: 356 - DNA, 60 bp, Artificial Sequence
  Synthetic Polynucleotide
taatacgactcactataggattattattattaccgcggagttttagagctagaaatagca

SEQ ID NO: 357 - DNA, 60 bp, Artificial Sequence
  Synthetic Polynucleotide
taatacgactcactataggattattattattattaccgcgttttagagctagaaatagca

SEQ ID NO: 358 - DNA, 60 bp, Artificial Sequence
  Synthetic Polynucleotide
taatacgactcactataggatattaatttatttatttaagttttagagctagaaatagca

SEQ ID NO: 359 - DNA, 60 bp, Artificial Sequence
  Synthetic Polynucleotide
taatacgactcactataggggaggacgtgcgcggccgccgttttagagctagaaatagca

SEQ ID NO: 360 - DNA, 60 bp, Artificial Sequence
  Synthetic Polynucleotide
taatacgactcactataggctgtggcagtggcaccagaagttttagagctagaaatagca

SEQ ID NO: 361 - DNA, 60 bp, Artificial Sequence
  Synthetic Polynucleotide
taatacgactcactatagggaagcgcctggcagtgtaccgttttagagctagaaatagca

SEQ ID NO: 362 - DNA, 60 bp, Artificial Sequence
  Synthetic Polynucleotide
taatacgactcactataggcctcccggccggcggtatccgttttagagctagaaatagca

SEQ ID NO: 363 - DNA, 60 bp, Artificial Sequence
  Synthetic Polynucleotide
taatacgactcactatagggcttgcagatggccatggcggttttagagctagaaatagca

SEQ ID NO: 364 - DNA, 60 bp, Artificial Sequence
  Synthetic Polynucleotide
taatacgactcactataggacacatgcagttgtagtggagttttagagctagaaatagca

SEQ ID NO: 365 - DNA, 60 bp, Artificial Sequence
  Synthetic Polynucleotide
taatacgactcactataggtgtcacacatgtagttgtaggttttagagctagaaatagca

SEQ ID NO: 366 - DNA, 31 bp, Artificial Sequence
  Synthetic Polynucleotide
gtaggtagttaggatgaatggaaggttggta

SEQ ID NO: 367 - DNA, 80 bp, Artificial Sequence
  Synthetic Polynucleotide
gtccatggatccagaggtcatccattaaataaataaatccgcggggctataccaaccttccattcatcctaactacctac

SEQ ID NO: 368 - DNA, 80 bp, Artificial Sequence
  Synthetic Polynucleotide
gtccatggatccagaggtcatccataaataaataaatccgcggaagctataccaaccttccattcatcctaactacctac

SEQ ID NO: 369 - DNA, 80 bp, Artificial Sequence
  Synthetic Polynucleotide
gtccatggatccagaggtcatccataataaataaatccgcggaaggctataccaaccttccattcatcctaactacctac

SEQ ID NO: 370 - DNA, 81 bp, Artificial Sequence
  Synthetic Polynucleotide
gtccatggatccagaggtcatccaaataaataaatccgcggaatggctataccaaccttccattcatcctaaactacctac

SEQ ID NO: 371 - DNA, 80 bp, Artificial Sequence
  Synthetic Polynucleotide
gtccatggatccagaggtcatccaataaataaatccgcggaataggctataccaaccttccattcatcctaactacctac

SEQ ID NO: 372 - DNA, 82 bp, Artificial Sequence
  Synthetic Polynucleotide
gtccatggatccagaggtcatccaataaataaatccgcggaataaggctatatccaaccttccattcatcctaactacctac

SEQ ID NO: 373 - DNA, 79 bp, Artificial Sequence
  Synthetic Polynucleotide
gtccatggatccagaggtcatccaaaataatccgcggaataatggctataccaaccttccattcatcctaactacctac

SEQ ID NO: 374 - DNA, 80 bp, Artificial Sequence
  Synthetic Polynucleotide
gtccatggatccagaggtcatccaaataaatccgcggaataataggctataccaaccttccattcatcctaactacctac

SEQ ID NO: 375 - DNA, 80 bp, Artificial Sequence
  Synthetic Polynucleotide
gtccatggatccagaggtcatccaataaatccgcggataataatggctataccaaccttccattcatcctaactacctac

SEQ ID NO: 376 - DNA, 80 bp, Artificial Sequence
  Synthetic Polynucleotide
gtccatggatccagaggtcatccataaatccgcggaatataataggctataccaaccttccattcatcctaactacctac

SEQ ID NO: 377 - DNA, 80 bp, Artificial Sequence
  Synthetic Polynucleotide
gtccatggatccagaggtcatccaaaatccgcggaatataataaggctataccaaccttccattcatcctaactacctac

SEQ ID NO: 378 - DNA, 80 bp, Artificial Sequence
  Synthetic Polynucleotide
gtccatggatccagaggtcatccaaatccgcggaatataataatggctataccaaccttccattcatcctaactacctac

SEQ ID NO: 379 - DNA, 80 bp, Artificial Sequence
  Synthetic Polynucleotide
gtccatggatccagaggtcatccaatccgcggaatataataataggctataccaaccttccattcatcctaactacctac

SEQ ID NO: 380 - DNA, 80 bp, Artificial Sequence
  Synthetic Polynucleotide
gtccatggatccagaggtcatccatccgcggtaataataataatggctataccaaccttccattcatcctaactacctac

SEQ ID NO: 381 - DNA, 80 bp, Artificial Sequence
  Synthetic Polynucleotide
gtccatggatccagaggtcatccagcggtaataataataataatggctataccaaccttccattcatcctaactacctac

SEQ ID NO: 382 - DNA, 81 bp, Artificial Sequence
  Synthetic Polynucleotide
gtccatggatccagaggtcatccattaaataaataaattaatattactataaccaaccttccattcatcctaactacctac

SEQ ID NO: 383 - DNA, 80 bp, Artificial Sequence
  Synthetic Polynucleotide
gtaggtagttaggatgaatggaaggttggtgtagattattatcugcggatttattggatgacctctggatccatggacat

SEQ ID NO: 384 - DNA, 80 bp, Artificial Sequence
  Synthetic Polynucleotide
gcacctcgccgcggtactgcaccaggcggccgcgcacgtcctccatgtctaccaaccttccattcatcctaactacctac

SEQ ID NO: 385 - DNA, 80 bp, Artificial Sequence
  Synthetic Polynucleotide
cggcgccctcgcgggccccggcctggtacactgccaggcgcttctgcagtaccaaccttccattcatcctaactacctac

SEQ ID NO: 386 - DNA, 80 bp, Artificial Sequence
  Synthetic Polynucleotide
ctcttacctggactctggaatccattctggtgccactgccacagctccttaccaaccttccattcatcctaactacctac

SEQ ID NO: 387 - DNA, 81 bp, Artificial Sequence
  Synthetic Polynucleotide
ggagacgtgcctgttggaacatcctggataccgccggccgggaggagtactaccaaccttccattcatcctaactacctac

SEQ ID NO: 388 - DNA, 80 bp, Artificial Sequence
  Synthetic Polynucleotide
acccccgcccggcacccgcgtccgcgccatggccatctgcaagcagtcataccaaccttccattcatcctaactacctac

SEQ ID NO: 389 - DNA, 80 bp, Artificial Sequence
  Synthetic Polynucleotide
aggttggctctgactgtaccaccatccactacaactgcatgtgtaacagtaccaaggttccattcatcctaactacctac

SEQ ID NO: 390 - DNA, 80 bp, Artificial Sequence
  Synthetic Polynucleotide
tggctctgactgtaccaccatccactacaactacatgtgtgacagttcctaccaaccttccattcatcctaactacctac

SEQ ID NO: 391 - DNA, 60 bp, Artificial Sequence
  Synthetic Polynucleotide
taatacgactcactataggttatttcgtggatttatttagttttagagctagaaatagca

SEQ ID NO: 392 - DNA, 60 bp, Artificial Sequence
  Synthetic Polynucleotide
taatacgactcactataggatatttcgtggatttatttagttttagagctagaaatagca

SEQ ID NO: 393 - DNA, 60 bp, Artificial Sequence
  Synthetic Polynucleotide
taatacgactcactataggctatttcgtggatttatttagttttagagctagaaatagca

SEQ ID NO: 394 - DNA, 60 bp, Artificial Sequence
  Synthetic Polynucleotide
taatacgactcactatagggtatttcgtggatttatttagttttagagctagaaatagca

SEQ ID NO: 395 - DNA, 60 bp, Artificial Sequence
  Synthetic Polynucleotide
taatacgactcactataggtaatttcgtggatttatttagttttagagctagaaatagca

SEQ ID NO: 396 - DNA, 60 bp, Artificial Sequence
  Synthetic Polynucleotide
taatacgactcactataggtcatttcgtggatttatttagttttagagctagaaatagca

SEQ ID NO: 397 - DNA, 60 bp, Artificial Sequence
  Synthetic Polynucleotide
taatacgactcactataggtgatttcgtggatttatttagttttagagctagaaatagca

SEQ ID NO: 398 - DNA, 60 bp, Artificial Sequence
  Synthetic Polynucleotide
taatacgactcactataggttttttcgtggatttatttagttttagagctagaaatagca

SEQ ID NO: 399 - DNA, 60 bp, Artificial Sequence
  Synthetic Polynucleotide
taatacgactcactataggttctttcgtggatttatttagttttagagctagaaatagca

SEQ ID NO: 400 - DNA, 60 bp, Artificial Sequence
  Synthetic Polynucleotide
taatacgactcactataggttgtttcgtggatttatttagttttagagctagaaatagca

SEQ ID NO: 401 - DNA, 60 bp, Artificial Sequence
  Synthetic Polynucleotide
taatacgactcactataggttaattcgtggatttatttagttttagagctagaaatagca

SEQ ID NO: 402 - DNA, 60 bp, Artificial Sequence
  Synthetic Polynucleotide
taatacgactcactataggttacttcgtggatttatttagttttagagctagaaatagca

SEQ ID NO: 403 - DNA, 60 bp, Artificial Sequence
  Synthetic Polynucleotide
taatacgactcactataggttagttcgtggatttatttagttttagagctagaaatagca

SEQ ID NO: 404 - DNA, 60 bp, Artificial Sequence
  Synthetic Polynucleotide
taatacgactcactataggttatatcgtggatttatttagttttagagctagaaatagca

SEQ ID NO: 405 - DNA, 60 bp, Artificial Sequence
  Synthetic Polynucleotide
taatacgactcactataggttatctcgtggatttatttagttttagagctagaaatagca

SEQ ID NO: 406 - DNA, 60 bp, Artificial Sequence
  Synthetic Polynucleotide
taatacgactcactataggttatgtcgtggatttatttagttttagagctagaaatagca

SEQ ID NO: 407 - DNA, 61 bp, Artificial Sequence
  Synthetic Polynucleotide
taatacgactcactataggttattatcgtggatttatttagttttagagctagaaatagca

SEQ ID NO: 408 - DNA, 61 bp, Artificial Sequence
  Synthetic Polynucleotide
taatacgactcactataggttattctcgtggatttatttagttttagagctagaaatagca

SEQ ID NO: 409 - DNA, 61 bp, Artificial Sequence
  Synthetic Polynucleotide
taatacgactcactataggttattgtcgtggatttatttagttttagagctagaaatagca

SEQ ID NO: 410 - DNA, 60 bp, Artificial Sequence
  Synthetic Polynucleotide
taatacgactcactataggttatttcatggatttatttagttttagagctagaaatagca

SEQ ID NO: 411 - DNA, 60 bp, Artificial Sequence
  Synthetic Polynucleotide
taatacgactcactataggttatttcttggatttatttagttttagagctagaaatagca

SEQ ID NO: 412 - DNA, 60 bp, Artificial Sequence
  Synthetic Polynucleotide
taatacgactcactataggttatttcctggatttatttagttttagagctagaaatagca

SEQ ID NO: 413 - DNA, 60 bp, Artificial Sequence
  Synthetic Polynucleotide
taatacgactcactataggttatttcgaggatttatttagttttagagctagaaatagca

SEQ ID NO: 414 - DNA, 60 bp, Artificial Sequence
  Synthetic Polynucleotide
taatacgactcactataggttatttcgcggatttatttagttttagagctagaaatagca

SEQ ID NO: 415 - DNA, 60 bp, Artificial Sequence
  Synthetic Polynucleotide
taatacgactcactataggttatttcggggatttatttagttttagagctagaaatagca

SEQ ID NO: 416 - DNA, 60 bp, Artificial Sequence
  Synthetic Polynucleotide
taatacgactcactataggttatttcgtagatttatttagttttagagctagaaatagca

SEQ ID NO: 417 - DNA, 60 bp, Artificial Sequence
  Synthetic Polynucleotide
taatacgactcactataggttatttcgttgatttatttagttttagagctagaaatagca

SEQ ID NO: 418 - DNA, 60 bp, Artificial Sequence
  Synthetic Polynucleotide
taatacgactcactataggttatttcgtcgatttatttagttttagagctagaaatagca

SEQ ID NO: 419 - DNA, 60 bp, Artificial Sequence
  Synthetic Polynucleotide
taatacgactcactataggttatttcgtgaatttatttagttttagagctagaaatagca

SEQ ID NO: 420 - DNA, 60 bp, Artificial Sequence
  Synthetic Polynucleotide
taatacgactcactataggttatttcgtgtatttatttagttttagagctagaaatagca

SEQ ID NO: 421 - DNA, 60 bp, Artificial Sequence
  Synthetic Polynucleotide
taatacgactcactataggttatttcgtgcatttatttagttttagagctagaaatagca

SEQ ID NO: 422 - DNA, 60 bp, Artificial Sequence
  Synthetic Polynucleotide
taatacgactcactataggttatttcgtggttttatttagttttagagctagaaatagca

SEQ ID NO: 423 - DNA, 60 bp, Artificial Sequence
  Synthetic Polynucleotide
taatacgactcactataggttatttcgtggctttatttagttttagagctagaaatagca

SEQ ID NO: 424 - DNA, 60 bp, Artificial Sequence
  Synthetic Polynucleotide
taatacgactcactataggttatttcgtgggtttatttagttttagagctagaaatagca

SEQ ID NO: 425 - DNA, 60 bp, Artificial Sequence
  Synthetic Polynucleotide
taatacgactcactataggttatttcgtggaattatttagttttagagctagaaatagca

SEQ ID NO: 426 - DNA, 60 bp, Artificial Sequence
  Synthetic Polynucleotide
taatacgactcactataggttatttcgtggacttatttagttttagagctagaaatagca

SEQ ID NO: 427 - DNA, 60 bp, Artificial Sequence
  Synthetic Polynucleotide
taatacgactcactataggttatttcgtggagttatttagttttagagctagaaatagca

SEQ ID NO: 428 - DNA, 60 bp, Artificial Sequence
  Synthetic Polynucleotide
taatacgactcactataggttccccccccgatttatttagttttagagctagaaatagca

SEQ ID NO: 429 - DNA, 60 bp, Artificial Sequence
  Synthetic Polynucleotide
taatacgactcactataggcgcacccgtggatttatttagttttagagctagaaatagca

SEQ ID NO: 430 - DNA, 60 bp, Artificial Sequence
  Synthetic Polynucleotide
taatacgactcactataggctcgcacgtggatttatttagttttagagctagaaatagca

SEQ ID NO: 431 - DNA, 60 bp, Artificial Sequence
  Synthetic Polynucleotide
taatacgactcactataggccctcgcgtggatttatttagttttagagctagaaatagca

SEQ ID NO: 432 - DNA, 60 bp, Artificial Sequence
  Synthetic Polynucleotide
taatacgactcactataggcaccctcgtggatttatttagttttagagctagaaatagca

SEQ ID NO: 433 - DNA, 60 bp, Artificial Sequence
  Synthetic Polynucleotide
taatacgactcactataggtcgcacccgtggatttattagttttagagctagaaatagca

SEQ ID NO: 434 - DNA, 60 bp, Artificial Sequence
  Synthetic Polynucleotide
taatacgactcactataggcctcgcacgtggatttattagttttagagctagaaatagca

SEQ ID NO: 435 - DNA, 60 bp, Artificial Sequence
  Synthetic Polynucleotide
taatacgactcactataggaccctcgcgtggatttattagttttagagctagaaatagca

SEQ ID NO: 436 - DNA, 60 bp, Artificial Sequence
  Synthetic Polynucleotide
taatacgactcactatagggcaccctcgtggatttattagttttagagctagaaatagca

SEQ ID NO: 437 - DNA, 60 bp, Artificial Sequence
  Synthetic Polynucleotide
taatacgactcactatagggagtccgagcagaagaagaagttttagagctagaaatagca

SEQ ID NO: 438 - DNA, 60 bp, Artificial Sequence
  Synthetic Polynucleotide
taatacgactcactataggggaatcccttctgcagcaccgttttagagctagaaatagca

SEQ ID NO: 439 - DNA, 60 bp, Artificial Sequence
  Synthetic Polynucleotide
taatacgactcactatagggaacacaaagcatagactgcgttttagagctagaaatagca

SEQ ID NO: 440 - DNA, 60 bp, Artificial Sequence
  Synthetic Polynucleotide
taatacgactcactataggggcccagactgagcacgtgagttttagagctagaaatagca

SEQ ID NO: 441 - DNA, 60 bp, Artificial Sequence
  Synthetic Polynucleotide
taatacgactcactataggggcactgcggctggaggtgggttttagagctagaaatagca

SEQ ID NO: 442 - DNA, 60 bp, Artificial Sequence
  Synthetic Polynucleotide
taatacgactcactatagggtcatcttagtcattacctggttttagagctagaaatagca

SEQ ID NO: 443 - DNA, 60 bp, Artificial Sequence
  Synthetic Polynucleotide
acgtaaacggccacaagttcttatttcgtggatttatttatggcatcttcttcaaggacg

SEQ ID NO: 444 - DNA, 60 bp, Artificial Sequence
  Synthetic Polynucleotide
acgtaaacggccacaagttcatatttcgtggatttatttatggcatcttcttcaaggacg

SEQ ID NO: 445 - DNA, 60 bp, Artificial Sequence
  Synthetic Polynucleotide
acgtaaacggccacaagttcctatttcgtggatttatttatggcatcttcttcaaggacg

SEQ ID NO: 446 - DNA, 60 bp, Artificial Sequence
  Synthetic Polynucleotide
acgtaaacggccacaagttcgtatttcgtggatttatttatggcatcttcttcaaggacg

SEQ ID NO: 447 - DNA, 60 bp, Artificial Sequence
  Synthetic Polynucleotide
acgtaaacggccacaagttctaatttcgtggatttatttatggcatcttcttcaaggacg

SEQ ID NO: 448 - DNA, 60 bp, Artificial Sequence
  Synthetic Polynucleotide
acgtaaacggccacaagttctcatttcgtggatttatttatggcatcttcttcaaggacg

SEQ ID NO: 449 - DNA, 60 bp, Artificial Sequence
  Synthetic Polynucleotide
acgtaaacggccacaagttctgatttcgtggatttatttatggcatcttcttcaaggacg

SEQ ID NO: 450 - DNA, 60 bp, Artificial Sequence
  Synthetic Polynucleotide
acgtaaacggccacaagttcttttttcgtggatttatttatggcatcttcttcaaggacg

SEQ ID NO: 451 - DNA, 60 bp, Artificial Sequence
  Synthetic Polynucleotide
acgtaaacggccacaagttcttctttcgtggatttatttatggcatcttcttcaaggacg

SEQ ID NO: 452 - DNA, 60 bp, Artificial Sequence
  Synthetic Polynucleotide
acgtaaacggccacaagttcttgtttcgtggatttatttatggcatcttcttcaaggacg

SEQ ID NO: 453 - DNA, 60 bp, Artificial Sequence
  Synthetic Polynucleotide
acgtaaacggccacaagttcttaattcgtggatttatttatggcatcttcttcaaggacg

SEQ ID NO: 454 - DNA, 60 bp, Artificial Sequence
  Synthetic Polynucleotide
acgtaaacggccacaagttcttacttcgtggatttatttatggcatcttcttcaaggacg

SEQ ID NO: 455 - DNA, 60 bp, Artificial Sequence
  Synthetic Polynucleotide
acgtaaacggccacaagttcttagttcgtggatttatttatggcatcttcttcaaggacg

SEQ ID NO: 456 - DNA, 60 bp, Artificial Sequence
  Synthetic Polynucleotide
acgtaaacggccacaagttcttatatcgtggatttatttatggcatcttcttcaaggacg

SEQ ID NO: 457 - DNA, 60 bp, Artificial Sequence
  Synthetic Polynucleotide
acgtaaacggccacaagttcttatctcgtggatttatttatggcatcttcttcaaggacg

SEQ ID NO: 458 - DNA, 60 bp, Artificial Sequence
  Synthetic Polynucleotide
acgtaaacggccacaagttcttatgtcgtggatttatttatggcatcttcttcaaggacg

SEQ ID NO: 459 - DNA, 60 bp, Artificial Sequence
  Synthetic Polynucleotide
acgtaaacggccacaagttcttattacgtggatttatttatggcatcttcttcaaggacg

SEQ ID NO: 460 - DNA, 60 bp, Artificial Sequence
  Synthetic Polynucleotide
acgtaaacggccacaagttcttattccgtggatttatttatggcatcttcttcaaggacg

SEQ ID NO: 461 - DNA, 60 bp, Artificial Sequence
  Synthetic Polynucleotide
acgtaaacggccacaagttcttattgcgtggatttatttatggcatcttcttcaaggacg

SEQ ID NO: 462 - DNA, 60 bp, Artificial Sequence
  Synthetic Polynucleotide
acgtaaacggccacaagttcttatttcatggatttatttatggcatcttcttcaaggacg

SEQ ID NO: 463 - DNA, 60 bp, Artificial Sequence
  Synthetic Polynucleotide
acgtaaacggccacaagttcttatttcttggatttatttatggcatcttcttcaaggacg

SEQ ID NO: 464 - DNA, 60 bp, Artificial Sequence
  Synthetic Polynucleotide
acgtaaacggccacaagttcttatttcctggatttatttatggcatcttcttcaaggacg

SEQ ID NO: 465 - DNA, 60 bp, Artificial Sequence
  Synthetic Polynucleotide
acgtaaacggccacaagttcttatttcgaagatttatttatggcatcttcttcaaggacg

SEQ ID NO: 466 - DNA, 60 bp, Artificial Sequence
  Synthetic Polynucleotide
acgtaaacggccacaagttcttatttcgacgatttatttatggcatcttcttcaaggacg

SEQ ID NO: 467 - DNA, 60 bp, Artificial Sequence
  Synthetic Polynucleotide
acgtaaacggccacaagttcttatttcgaggatttatttatggcatcttcttcaaggacg

SEQ ID NO: 468 - DNA, 60 bp, Artificial Sequence
  Synthetic Polynucleotide
acgtaaacggccacaagttcttatttcgtagatttatttatggcatcttcttcaaggacg

SEQ ID NO: 469 - DNA, 60 bp, Artificial Sequence
  Synthetic Polynucleotide
acgtaaacggccacaagttcttatttcgttgatttatttatggcatcttcttcaaggacg

SEQ ID NO: 470 - DNA, 60 bp, Artificial Sequence
  Synthetic Polynucleotide
acgtaaacggccacaagttcttatttcgtcgatttatttatggcatcttcttcaaggacg

SEQ ID NO: 471 - DNA, 60 bp, Artificial Sequence
  Synthetic Polynucleotide
acgtaaacggccacaagttcttatttcgtgaatttatttatggcatcttcttcaaggacg

SEQ ID NO: 472 - DNA, 60 bp, Artificial Sequence
  Synthetic Polynucleotide
acgtaaacggccacaagttcttatttcgtgtatttatttatggcatcttcttcaaggacg

SEQ ID NO: 473 - DNA, 60 bp, Artificial Sequence
  Synthetic Polynucleotide
acgtaaacggccacaagttcttatttcgtgcatttatttatggcatcttcttcaaggacg

SEQ ID NO: 474 - DNA, 60 bp, Artificial Sequence
  Synthetic Polynucleotide
acgtaaacggccacaagttcttatttcgtggttttatttatggcatcttcttcaaggacg

SEQ ID NO: 475 - DNA, 60 bp, Artificial Sequence
  Synthetic Polynucleotide
acgtaaacggccacaagttcttatttcgtggctttatttatggcatcttcttcaaggacg

SEQ ID NO: 476 - DNA, 60 bp, Artificial Sequence
  Synthetic Polynucleotide
acgtaaacggccacaagttcttatttcgtgggtttatttatggcatcttcttcaaggacg

SEQ ID NO: 477 - DNA, 60 bp, Artificial Sequence
  Synthetic Polynucleotide
acgtaaacggccacaagttcttatttcgtggaattatttatggcatcttcttcaaggacg

SEQ ID NO: 478 - DNA, 60 bp, Artificial Sequence
  Synthetic Polynucleotide
acgtaaacggccacaagttcttatttcgtggacttatttatggcatcttcttcaaggacg

SEQ ID NO: 479 - DNA, 60 bp, Artificial Sequence
  Synthetic Polynucleotide
acgtaaacggccacaagttcttatttcgtggagttatttatggcatcttcttcaaggacg

SEQ ID NO: 480 - DNA, 61 bp, Artificial Sequence
  Synthetic Polynucleotide
acgtaaacggccacaaagtttcgcacccgtggatttatttatggcatcttcttcaaggacg

SEQ ID NO: 481 - DNA, 60 bp, Artificial Sequence
  Synthetic Polynucleotide
acgtaaacggccacaagttcctcgcacgtggatttatttatggcatcttcttcaaggacg

SEQ ID NO: 482 - DNA, 60 bp, Artificial Sequence
  Synthetic Polynucleotide
acgtaaacggccacaagttaccctcgcgtggatttatttatggcatcttcttcaaggacg

SEQ ID NO: 483 - DNA, 60 bp, Artificial Sequence
  Synthetic Polynucleotide
acgtaaacggccacaagttgcaccctcgtggatttatttatggcatcttcttcaaggacg

SEQ ID NO: 484 - DNA, 60 bp, Artificial Sequence
  Synthetic Polynucleotide
acgtaaacggccacaagtattcgcacccgtggatttattatggcatcttcttcaaggacg

SEQ ID NO: 485 - DNA, 60 bp, Artificial Sequence
  Synthetic Polynucleotide
acgtaaacggccacaagtatcctcgcacgtggatttattatggcatcttcttcaaggacg

SEQ ID NO: 486 - DNA, 60 bp, Artificial Sequence
  Synthetic Polynucleotide
acgtaaacggccacaagtataccctcgcgtggatttattatggcatcttcttcaaggacg

SEQ ID NO: 487 - DNA, 60 bp, Artificial Sequence
  Synthetic Polynucleotide
acgtaaacggccacaagtatgcaccctcgtggatttattatggcatcttcttcaaggacg

SEQ ID NO: 488 - DNA, 80 bp, Artificial Sequence
  Synthetic Polynucleotide
gtaggtagttaggatgaatggaaggttggtaggcctgagtccgagcagaagaagaagggctcccatcacatcaaccggtg

SEQ ID NO: 489 - DNA, 80 bp, Artificial Sequence
  Synthetic Polynucleotide
gtaggtagttaggatgaatggaaggttggtactcatggaatcccttctgcagcacctggatcgcttttccgagcttctgg

SEQ ID NO: 490 - DNA, 80 bp, Artificial Sequence
  Synthetic Polynucleotide
gtaggtagttaggatgaatggaaggttggtaaactggaacacaaagcatagactgcggggcgggccagcctgaatagctg

SEQ ID NO: 491 - DNA, 80 bp, Artificial Sequence
  Synthetic Polynucleotide
gtaggtagttaggatgaatggaaggttggtacttggggcccagactgagcacgtgatggcagaggaaaggaagccctgct

SEQ ID NO: 492 - DNA, 80 bp, Artificial Sequence
  Synthetic Polynucleotide
gtaggtagttaggatgaatggaaggttggtaccggtggcactgcggctggaggtgggggttaaagcggagactctggtgc

SEQ ID NO: 493 - DNA, 80 bp, Artificial Sequence
  Synthetic Polynucleotide
gtaggtagttaggatgaatggaaggttggtatggcagtcatcttagtcattacctgaggtgttcgttgtaactcatataa

SEQ ID NO: 494 - DNA, 81 bp, Artificial Sequence
  Synthetic Polynucleotide
gtaggtagttaggatgaatggaaggttggtatggcagtcatcttagtcattaccttgaggtgttcgttgtaactcatataa

SEQ ID NO: 495 - DNA, 53 bp, Artificial Sequence
  Synthetic Polynucleotide
  misc_feature (34)..(37): n is a, c, g, or t
acactctttccctacacgacgctcttccgatctnnnnacgtaaacggccacaa

SEQ ID NO: 496 - DNA, 47 bp, Artificial Sequence
  Synthetic Polynucleotide
tggagttcagacgtgtgctcttccgatctcgtccttgaagaagatgc

SEQ ID NO: 497 - DNA, 60 bp, Artificial Sequence
  Synthetic Polynucleotide
  misc_feature (34)..(37): n is a, c, g, or t
acactctttccctacacgacgctcttccgatctnnnngtaggtagttaggatgaatggaa

SEQ ID NO: 498 - DNA, 47 bp, Artificial Sequence
  Synthetic Polynucleotide
tggagttcagacgtgtgctcttccgatctcaccggttgatgtgatgg

SEQ ID NO: 499 - DNA, 47 bp, Artificial Sequence
  Synthetic Polynucleotide
tggagttcagacgtgtgctcttccgatctccagaagctcggaaaagc

SEQ ID NO: 500 - DNA, 46 bp, Artificial Sequence
  Synthetic Polynucleotide
tggagttcagacgtgtgctcttccgatctcagctattcaggctggc

SEQ ID NO: 501 - DNA, 45 bp, Artificial Sequence
  Synthetic Polynucleotide
tggagttcagacgtgtgctcttccgatctagcagggcttcctttc

SEQ ID NO: 502 - DNA, 44 bp, Artificial Sequence
  Synthetic Polynucleotide
tggagttcagacgtgtgctcttccgatctgcaccagagtctccg

SEQ ID NO: 503 - DNA, 52 bp, Artificial Sequence
  Synthetic Polynucleotide
tggagttcagacgtgtgctcttccgatctttatatgagttacaacgaacacc

SEQ ID NO: 504 - DNA, 57 bp, Artificial Sequence
  Synthetic Polynucleotide
  misc_feature (34)..(37): n is a, c, g, or t
acactctttccctacacgacgctcttccgatctnnnncagctcagcctgagtgttga

SEQ ID NO: 505 - DNA, 48 bp, Artificial Sequence
  Synthetic Polynucleotide
tggagttcagacgtgtgctcttccgatctctcgtgggtttgtggttgc

SEQ ID NO: 506 - DNA, 57 bp, Artificial Sequence
  Synthetic Polynucleotide
  misc_feature (34)..(37): n is a, c, g, or t
acactctttccctacacgacgctcttccgatctnnnncattgcagagaggcgtatca

SEQ ID NO: 507 - DNA, 47 bp, Artificial Sequence
  Synthetic Polynucleotide
tggagttcagacgtgtgctcttccgatctggggtcccaggtgctgac

SEQ ID NO: 508 - DNA, 57 bp, Artificial Sequence
  Synthetic Polynucleotide
  misc_feature (34)..(37): n is a, c, g, or t
acactctttccctacacgacgctcttccgatctnnnnccagccccatctgtcaaact

SEQ ID NO: 509 - DNA, 53 bp, Artificial Sequence
  Synthetic Polynucleotide
tggagttcagacgtgtgctcttccgatcttgaatggattcttggaaacaatga

SEQ ID NO: 510 - DNA, 57 bp, Artificial Sequence
  Synthetic Polynucleotide
  misc_feature (34)..(37): n is a, c, g, or t
acactctttccctacacgacgctcttccgatctnnnnatgtgggctgcctagaaagg

SEQ ID NO: 511 - DNA, 49 bp, Artificial Sequence
  Synthetic Polynucleotide
tggagttcagacgtgtgctcttccgatctcccagccaaacttgtcaacc

SEQ ID NO: 512 - DNA, 57 bp, Artificial Sequence
  Synthetic Polynucleotide
  misc_feature (34)..(37): n is a, c, g, or t
acactctttccctacacgacgctcttccgatctnnnngaacccaggtagccagagac

SEQ ID NO: 513 - DNA, 49 bp, Artificial Sequence
  Synthetic Polynucleotide
tggagttcagacgtgtgctcttccgatcttcctttcaacccgaacggag

SEQ ID NO: 514 - DNA, 60 bp, Artificial Sequence
  Synthetic Polynucleotide
  misc_feature (34)..(37): n is a, c, g, or t
acactctttccctacacgacgctcttccgatctnnnnctcttctttatttccagcaatgt

SEQ ID NO: 515 - DNA, 56 bp, Artificial Sequence
  Synthetic Polynucleotide
tggagttcagacgtgtgctcttccgatctgttttcatgttctaaaaatgtatccca

SEQ ID NO: 516 - DNA, 57 bp, Artificial Sequence
  Synthetic Polynucleotide
  misc_feature (34)..(37): n is a, c, g, or t
acactctttccctacacgacgctcttccgatctnnnntacagtactcccctgccctc

SEQ ID NO: 517 - DNA, 49 bp, Artificial Sequence
  Synthetic Polynucleotide
tggagttcagacgtgtgctcttccgatctgctgctcaccatcgctatct

SEQ ID NO: 518 - DNA, 57 bp, Artificial Sequence
  Synthetic Polynucleotide
  misc_feature (34)..(37): n is a, c, g, or t
acactctttccctacacgacgctcttccgatctnnnncctcatcttgggcctgtgtt

SEQ ID NO: 519 - DNA, 49 bp, Artificial Sequence
  Synthetic Polynucleotide
tggagttcagacgtgtgctcttccgatctaaatcggtaagaggtgggcc

SEQ ID NO: 520 - DNA, 55 bp, Artificial Sequence
  Synthetic Polynucleotide
  misc_feature (34)..(37): n is a, c, g, or t
acactctttccctacacgacgctcttccgatctnnnngcggacatggaggacgtg

SEQ ID NO: 521 - DNA, 47 bp, Artificial Sequence
  Synthetic Polynucleotide
tggagttcagacgtgtgctcttccgatctctgttccaccaggggccc

SEQ ID NO: 522 - DNA, 58 bp, Artificial Sequence
  Synthetic Polynucleotide
  misc_feature (34)..(37): n is a, c, g, or t
acactctttccctacacgacgctcttccgatctnnnntgcccaatcattgatgctttt

SEQ ID NO: 523 - DNA, 56 bp, Artificial Sequence
  Synthetic Polynucleotide
tggagttcagacgtgtgctcttccgatctagaaacatttaccatagactatcacct

SEQ ID NO: 524 - DNA, 59 bp, Artificial Sequence
  Synthetic Polynucleotide
  misc_feature (34)..(37): n is a, c, g, or t
acactctttccctacacgacgctcttccgatctnnnnagtagcctctttctcaatgtgc

SEQ ID NO: 525 - DNA, 50 bp, Artificial Sequence
  Synthetic Polynucleotide
tggagttcagacgtgtgctcttccgatctgctttcacaaggatgcagtct

SEQ ID NO: 526 - DNA, 56 bp, Artificial Sequence
  Synthetic Polynucleotide
  misc_feature (34)..(37): n is a, c, g, or t
acactctttccctacacgacgctcttccgatctnnnngagctagactccgagggga

SEQ ID NO: 527 - DNA, 49 bp, Artificial Sequence
  Synthetic Polynucleotide
tggagttcagacgtgtgctcttccgatcttcctcgtcctgctctcactt

SEQ ID NO: 528 - DNA, 58 bp, Artificial Sequence
  Synthetic Polynucleotide
  misc_feature (34)..(37): n is a, c, g, or t
acactctttccctacacgacgctcttccgatctnnnnagaggctgaagaggaagacca

SEQ ID NO: 529 - DNA, 49 bp, Artificial Sequence
  Synthetic Polynucleotide
tggagttcagacgtgtgctcttccgatctggcccagctgtgcattctat

SEQ ID NO: 530 - DNA, 56 bp, Artificial Sequence
  Synthetic Polynucleotide
  misc_feature (34)..(37): n is a, c, g, or t
acactctttccctacacgacgctcttccgatctnnnnccaagagggccaagtcctg

SEQ ID NO: 531 - DNA, 47 bp, Artificial Sequence
  Synthetic Polynucleotide
tggagttcagacgtgtgctcttccgatctcagcgaggagtgacagcc

SEQ ID NO: 532 - DNA, 57 bp, Artificial Sequence
  Synthetic Polynucleotide
  misc_feature (34)..(37): n is a, c, g, or t
acactctttccctacacgacgctcttccgatctnnnncactccacctgatctcgggg

SEQ ID NO: 533 - DNA, 47 bp, Artificial Sequence
  Synthetic Polynucleotide
tggagttcagacgtgtgctcttccgatctcgaggagggagggagcag

SEQ ID NO: 534 - DNA, 57 bp, Artificial Sequence
  Synthetic Polynucleotide
  misc_feature (34)..(37): n is a, c, g, or t
acactctttccctacacgacgctcttccgatctnnnnaccacaaatgcccaagagac

SEQ ID NO: 535 - DNA, 47 bp, Artificial Sequence
  Synthetic Polynucleotide
tggagttcagacgtgtgctcttccgatctgacacagtcaagggccgg

SEQ ID NO: 536 - DNA, 57 bp, Artificial Sequence
  Synthetic Polynucleotide
  misc_feature (34)..(37): n is a, c, g, or t
acactctttccctacacgacgctcttccgatctnnnncccacctttgaggaggcaaa

SEQ ID NO: 537 - DNA, 51 bp, Artificial Sequence
  Synthetic Polynucleotide
tggagttcagacgtgtgctcttccgatctttccatctgagaagagagtggt

SEQ ID NO: 538 - DNA, 57 bp, Artificial Sequence
  Synthetic Polynucleotide
  misc_feature (34)..(37): n is a, c, g, or t
acactctttccctacacgacgctcttccgatctnnnngtcataccttggcccttcct

SEQ ID NO: 539 - DNA, 47 bp, Artificial Sequence
  Synthetic Polynucleotide
tggagttcagacgtgtgctcttccgatcttccctaggcccacaccag

SEQ ID NO: 540 - DNA, 57 bp, Artificial Sequence
  Synthetic Polynucleotide
  misc_feature (34)..(37): n is a, c, g, or t
acactctttccctacacgacgctcttccgatctnnnnaacccactgaagaagcaggg

SEQ ID NO: 541 - DNA, 49 bp, Artificial Sequence
  Synthetic Polynucleotide
tggagttcagacgtgtgctcttccgatctggtgcttaatccggctccat

SEQ ID NO: 542 - DNA, 57 bp, Artificial Sequence
  Synthetic Polynucleotide
  misc_feature (34)..(37): n is a, c, g, or t
acactctttccctacacgacgctcttccgatctnnnntccagtgtttccatcccgaa

SEQ ID NO: 543 - DNA, 49 bp, Artificial Sequence
  Synthetic Polynucleotide
tggagttcagacgtgtgctcttccgatctcctctgacctccacaactct

SEQ ID NO: 544 - DNA, 57 bp, Artificial Sequence
  Synthetic Polynucleotide
  misc_feature (34)..(37): n is a, c, g, or t
acactctttccctacacgacgctcttccgatctnnnnctgggtacagttctgcgtgt

SEQ ID NO: 545 - DNA, 49 bp, Artificial Sequence
  Synthetic Polynucleotide
tggagttcagacgtgtgctcttccgatcttcactctgagcatcgccaag

SEQ ID NO: 546 - DNA, 60 bp, Artificial Sequence
  Synthetic Polynucleotide
  misc_feature (34)..(37): n is a, c, g, or t
acactctttccctacacgacgctcttccgatctnnnnggtttagagccagtgaactagag

SEQ ID NO: 547 - DNA, 56 bp, Artificial Sequence
  Synthetic Polynucleotide
tggagttcagacgtgtgctcttccgatctgcaagacaaaatcctctttatactttg

SEQ ID NO: 548 - DNA, 55 bp, Artificial Sequence
  Synthetic Polynucleotide
  misc_feature (34)..(37): n is a, c, g, or t
acactctttccctacacgacgctcttccgatctnnnngggaggggacggccttac

SEQ ID NO: 549 - DNA, 47 bp, Artificial Sequence
  Synthetic Polynucleotide
tggagttcagacgtgtgctcttccgatctgcctctggcgaacatggc

SEQ ID NO: 550 - DNA, 57 bp, Artificial Sequence
  Synthetic Polynucleotide
  misc_feature (34)..(37): n is a, c, g, or t
acactctttccctacacgacgctcttccgatctnnnntcctggttaagagcatgggc

SEQ ID NO: 551 - DNA, 49 bp, Artificial Sequence
  Synthetic Polynucleotide
tggagttcagacgtgtgctcttccgatctgattgagtccccacagcaca

SEQ ID NO: 552 - DNA, 57 bp, Artificial Sequence
  Synthetic Polynucleotide
  misc_feature (34)..(37): n is a, c, g, or t
acactctttccctacacgacgctcttccgatctnnnnccagtgtttcccatccccaa

SEQ ID NO: 553 - DNA, 50 bp, Artificial Sequence
  Synthetic Polynucleotide
tggagttcagacgtgtgctcttccgatcttgacctccacaactggaaaat

SEQ ID NO: 554 - DNA, 57 bp, Artificial Sequence
  Synthetic Polynucleotide
  misc_feature (34)..(37): n is a, c, g, or t
acactctttccctacacgacgctcttccgatctnnnngcttccagacccacctgaag

SEQ ID NO: 555 - DNA, 50 bp, Artificial Sequence
  Synthetic Polynucleotide
tggagttcagacgtgtgctcttccgatctaccgaggaaaattgcttgtcg

SEQ ID NO: 556 - DNA, 58 bp, Artificial Sequence
  Synthetic Polynucleotide
  misc_feature (34)..(37): n is a, c, g, or t
acactctttccctacacgacgctcttccgatctnnnngtgtggagagtgagtaagcca

SEQ ID NO: 557 - DNA, 50 bp, Artificial Sequence
  Synthetic Polynucleotide
tggagttcagacgtgtgctcttccgatctacggtaggatgatttcaggca

SEQ ID NO: 558 - DNA, 58 bp, Artificial Sequence
  Synthetic Polynucleotide
  misc_feature (34)..(37): n is a, c, g, or t
acactctttccctacacgacgctcttccgatctnnnncacaaagcagtgtagctcagg

SEQ ID NO: 559 - DNA, 54 bp, Artificial Sequence
  Synthetic Polynucleotide
tggagttcagacgtgtgctcttccgatcttttttggtactcgagtgttattcag

SEQ ID NO: 560 - DNA, 57 bp, Artificial Sequence
  Synthetic Polynucleotide
  misc_feature (34)..(37): n is a, c, g, or t
acactctttccctacacgacgctcttccgatctnnnntcccctgttgacctggagaa

SEQ ID NO: 561 - DNA, 49 bp, Artificial Sequence
  Synthetic Polynucleotide
tggagttcagacgtgtgctcttccgatctcactgtacttgccctgacca

SEQ ID NO: 562 - DNA, 57 bp, Artificial Sequence
  Synthetic Polynucleotide
  misc_feature (34)..(37): n is a, c, g, or t
acactctttccctacacgacgctcttccgatctnnnnttggtgttgacagggagcaa

SEQ ID NO: 563 - DNA, 49 bp, Artificial Sequence
  Synthetic Polynucleotide
tggagttcagacgtgtgctcttccgatctctgagatgtgggcagaaggg

SEQ ID NO: 564 - DNA, 57 bp, Artificial Sequence
  Synthetic Polynucleotide
  misc_feature (34)..(37): n is a, c, g, or t
acactctttccctacacgacgctcttccgatctnnnntgagagggaacagaagggct

SEQ ID NO: 565 - DNA, 49 bp, Artificial Sequence
  Synthetic Polynucleotide
tggagttcagacgtgtgctcttccgatgtgtccaaaggcccaagaacct

SEQ ID NO: 566 - DNA, 58 bp, Artificial Sequence
  Synthetic Polynucleotide
  misc_feature (34)..(37): n is a, c, g, or t
acactctttccctacacgacgctcttccgatctnnnntcctagcactttggaaggtcg

SEQ ID NO: 567 - DNA, 51 bp, Artificial Sequence
  Synthetic Polynucleotide
tggagttcagacgtgtgctcttccgatctgctcatcttaatctgctcagcc

SEQ ID NO: 568 - DNA, 57 bp, Artificial Sequence
  Synthetic Polynucleotide
  misc_feature (34)..(37): n is a, c, g, or t
acactctttccctacacgacgctcttccgatctnnnnaaaggagcagctcttcctgg

SEQ ID NO: 569 - DNA, 49 bp, Artificial Sequence
  Synthetic Polynucleotide
tggagttcagacgtgtgctcttccgatctgtctgcaccatctcccacaa

SEQ ID NO: 570 - DNA, 57 bp, Artificial Sequence
  Synthetic Polynucleotide
  misc_feature (34)..(37): n is a, c, g, or t
acactctttccctacacgacgctcttccgatctnnnnggcatggcttctgagactca

SEQ ID NO: 571 - DNA, 53 bp, Artificial Sequence
  Synthetic Polynucleotide
tggagttcagacgtgtgctcttccgatctgtctcccttgcactccctgtcttt

SEQ ID NO: 572 - DNA, 57 bp, Artificial Sequence
  Synthetic Polynucleotide
  misc_feature (34)..(37): n is a, c, g, or t
acactctttccctacacgacgctcttccgatctnnnntttggcaatggaggcattgg

SEQ ID NO: 573 - DNA, 49 bp, Artificial Sequence
  Synthetic Polynucleotide
tggagttcagacgtgtgctcttccgatctgaagaggctgcccatgagag

SEQ ID NO: 574 - DNA, 57 bp, Artificial Sequence
  Synthetic Polynucleotide
  misc_feature (34)..(37): n is a, c, g, or t
acactctttccctacacgacgctcttccgatctnnnnggtctgaggctcgaatcctg

SEQ ID NO: 575 - DNA, 49 bp, Artificial Sequence
  Synthetic Polynucleotide
tggagttcagacgtgtgctcttccgatctctgtggcctccatatccctg

SEQ ID NO: 576 - DNA, 57 bp, Artificial Sequence
  Synthetic Polynucleotide
  misc_feature (34)..(37): n is a, c, g, or t
acactctttccctacacgacgctcttccgatctnnnntttccaccagaactcagccc

SEQ ID NO: 577 - DNA, 49 bp, Artificial Sequence
  Synthetic Polynucleotide
tggagttcagacgtgtgctcttccgatctcctcggttcctccacaacac

SEQ ID NO: 578 - DNA, 57 bp, Artificial Sequence
  Synthetic Polynucleotide
  misc_feature (34)..(37): n is a, c, g, or t
acactctttccctacacgacgctcttccgatctnnnncacgggaaggacaggagaag

SEQ ID NO: 579 - DNA, 49 bp, Artificial Sequence
  Synthetic Polynucleotide
tggagttcagacgtgtgctcttccgatctgcaggggagggataaagcag

SEQ ID NO: 580 - DNA, 200 bp, Artificial Sequence
  Synthetic Polynucleotide
tcatctgtgcccctccctccctggcccaggtgaaggtgtggttccagaaccggaggacaaagtacaaacggcagaagctggaggaggaagggcctgagtttgagcagaagaagaagggctcccatcacatcaaccggtggcgcattgccacgaagcaggccaatggggaggacatcgatgtcacctccaatgactagggt

SEQ ID NO: 581 - DNA, 200 bp, Artificial Sequence
  Synthetic Polynucleotide
accctagtcattggaggtgacatcgatctcctccccattggcctgcttcgtggcaatgcgccaccggttgatgtgatgggagcccttcttcttctgctcaaactcaggcccttcctcctccagcttctgccgtttgtactttgtcctccggttctggaaccacaccttcacctgggccagggagggaggggcacagatga

SEQ ID NO: 582 - DNA, 201 bp, Artificial Sequence
  Synthetic Polynucleotide
catgcaattagtctatttctgctgcaagtaagcatgcatttgtaggcttgatgctttttttctgcttctccagccctggcctgggtcaatccttggggcttagactgagcacgtgatggcagaggaaaggaagccctgcttcctccagagggcgtcgcaggacagcttttcctagacagggggctagtatgtgcagctcct

SEQ ID NO: 583 - DNA, 200 bp, Artificial Sequence
  Synthetic Polynucleotide
aggagctgcacatactagcccctgtctaggaaaagctgtcctgcgacgccctctggaggaagcagggcttcctttcctctgccatcacgtgctcagtctaagccccaaggattgacccaggccagggctggagaagcagaaaaaaagcatcaagcctacaaatgcatgcttacttgcagcagaaatagactaattgcatc

SEQ ID NO: 584 - DNA, 200 bp, Artificial Sequence
  Synthetic Polynucleotide
ggctgacaaaggccgggctgggtggaaggaagggaggaagggcgaggcagagggtccaaagcaggatgacaggcaggggcaccgcggcgccccggtggcattgcggctggaggtgggggttaaagcggagactctggtgctgtgtgactacagtgggggccctgccctctctgagcccccgcctccaggcctgtgtgtgt

SEQ ID NO: 585 - DNA, 200 bp, Artificial Sequence
  Synthetic Polynucleotide
acacacacaggcctggaggcgggggctcagagagggcagggcccccactgtagtcacacagcaccagagtctccgctttaacccccacctccagccgcaatgccaccggggcgccgcggtgcccctgcctgtcatcctgctttggaccctctgcctcgcccttcctcccttccttccacccagcccggcctttgtcagcc

SEQ ID NO: 586 - DNA, 661 bp, Artificial Sequence
  Synthetic Polynucleotide
catccttggtaccgagctcggatccagccaccatggatagcctcttgatgaatagacgcaagttcctgtatcagtttaaaaacgtgagatgggcaaaaggccgacgagagacatatctgtgctatgtcgttaagcgcagagattcagccaccagtttctctctcgacttcggctacctgcggaacaagaatggttgccatgttgagctcctgttcctgaggtatatcagcgactgggatttggacccagggcggtgctatagggtgacatggtttacctcctggtcaccttgttatgactgcgcgcggcatgttgccgattttctgagagggaaccctaacctgtctctgaggatcttcaccgcgcgactgtacttctgtgaggaccggaaagccgaacccgagggactgagacgcctccacagagcgggtgtgcagattgccataatgacctttaaggactacttctactgctggaacaccttcgtcgaaaatcacgagcggactttcaaggcttgggaaggattgcatgaaaacagcgtcaggctttccaggcagcttcgccgcattcttctcccgttgtacgaggttgatgacctcagagatgcctttagaacactgggactgtaggcggccgctcgattggtttggtgtggctctaa

SEQ ID NO: 587 - DNA, 755 bp, Homo sapiens
catccttggtaccgagctcggatccagccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcgggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttctgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatgagcggccgctcgattggtttggtgtggctctaa

SEQ ID NO: 588 - DNA, 694 bp, Artificial Sequence
  Synthetic Polynucleotide
catccttggtaccgagctcggatccagccaccatgacagacgctgaatatgttaggatccatgaaaaactggatatctatacatttaagaagcagttcttcaataacaaaaagtcagtatctcacagatgctatgtcctgttcgaactcaagagaagaggagagaaaggcgggcctgtttctgggggtacgcggttaataaaccccagtccgggaccgagaggggggattcacgccgagatcttttcaattaggaaggttgaagagtatcttcgcgacaatcccggtcagttcacaattaactggtacagctcctggagcccttgcgctgattgcgccgagaaaatactcgaatggtacaaccaggacttgagaggcaatggccacactctcaagatttgggcttgcaagctttactacgagaagaacgcgagaaatcagattggcttgtggaacctcagggacaacggggtcgggttgaatgttatggtgtccgaacattaccagtgctgtagaaagatcttcattcagtccagtcacaatcagctgaacgagaacagatggctggagaaaacactgaaacgggcagagaaaaggcgctcagagctgagtatcatgatccaggtcaaaatcctgcatacaaccaaaagcccggctgtataagcggccgctcgattggtttggtgtggctctaa

SEQ ID NO: 589 - DNA, 1045 bp, Artificial Sequence
  Synthetic Polynucleotide
catccttggtaccgagctcggatccagccaccatggagctgaagtatcaccctgagatgcggtttttccactggtttagtaagtggcgcaaacttcatcgggatcaggagtatgaagtgacctggtatatctcttggtctccctgcacaaaatgtacacgcgavatggaaacatttctggccgaggatccaaaggtgacgctcacaaatctttgtggcccgcctgtattatttctgggacccggattatcaggaggcacttaggtcattgtgccaaaagcgcgacggaccacgggcgactatgaaaatcatgaattatgacgaattccagcattgctggagtaagtttgtgtacagccagcgggagctgttcgagccctggaacaatcttcccaagtactacatactgcttcacattatgttgggggagatccttcggcactctatggatcctcctaccctttacgtttaaactttaataatgagccttgggttcgcgggcgccatgaaacctatttgtgctacgaggtcgagcggatccataatgatacgtgggtcctgctgaatcagaggagggggtttctgtgtaaccaggctccacataaagatggatttctcgaggggcggcacgccgaactgtgtttccttgatgtgatacctttctggaagctcgaccttgatcaagattacagggtgacgtgtttcacctcctggtcaccctgcttcagttgcgcccaagagatggctaaatttagcagtaagaacaagcatgtgtccctctgtatttttacagccagaatttatgatgaccagggccggtgccaggaggggctgcggacactcgctgaggcgggcgcgaagatcagcataatgacatactccgaattcaaacactgttgggacacttttgtggaccaccagggctgcccatttcagccgtgggatgggctcgacgaacatagtcaggatctctcaggccggctgcgagccatattgcagaaccaggagaattaggcggccgctcgattggtttggtgtggctctaa

SEQ ID NO: 590 - DNA, 785 bp, Escherichia coli
ggccggggattctagaaataattttgtttaactttaagaaggagatataccatggatgtcttctgaaaccggtccggttgcggttgacccgaccctgcgtcgtcgtatcgaaccgcacgaattcgaagttttcttcgaccccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctcctcgtgcgatcaccgaattcctgtctcgttacccgcacgttaccctgttcatctacatcgcgcgtctgtaccaccacgcggacccgcgtaaccgtcagggtctgcgtgacctgatctcttctggtgttaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgacctcttcaccatcgcgctgcagtcttgccactaccagcgtctgccgccgcacatcctgtgggcgaccggtctgaaaggtggtagtggagggagcggcggttcaatggataagaaatac

SEQ ID NO: 591 - protein, 772 aa, Artificial Sequence
  Synthetic Polypeptide
MGSSHHHHHHMSSETGPVAVDPTLRRRIEPHEFEVEFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEILANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 592 - protein, 1622 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMFRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 593 - protein, 1709 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYEILFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELYKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGYALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLSDAPEYKPWALVIQDSNGENKIKMLSGGSPKKKRKV

SEQ ID NO: 594 - protein, 1708 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREDIEKILTFRIPYYVGPLARGNSRFAWMTRKSEETITPWNFEEVVDKGASAQSFIERMTNDKNLPNEKVLPKHSLLYEYFTVYNELTKVKYVTEGMRKPAFLSSGEQKKAIVDLLFKTNRKVTVKQLKEDYFKKIECFDSVEISGVEDRFNASLGTYGDLLKIIKDIDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 595 - DNA, 246 bp, Artificial Sequence
  Synthetic Polynucleotide
gcggacatggaggacgtgcgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacag

SEQ ID NO: 596 - DNA, 9 bp, Artificial Sequence
  Synthetic Polynucleotide
ggsggsggs

SEQ ID NO: 597 - DNA, 21 bp, Artificial Sequence
  Synthetic Polynucleotide
ggsggsggsggsggsggsggs

SEQ ID NO: 598 - protein, 36 aa, Artificial Sequence
  Synthetic Polypeptide
  misc_feature (2)..(2): Xaa can be any naturally occurring amino acid
  misc_feature (4)..(26): Xaa can be any naturally occurring amino acid
  misc_feature (27)..(29): Xaa may be absent
  misc_feature (32)..(33): Xaa can be any naturally occurring amino acid
  misc_feature (34)..(35): Xaa may be absent
HXEXXXXXXXXXXXXXXXXXXXXXXXXXXPCXXXXC

SEQ ID NO: 599 - protein, 11 aa, Artificial Sequence
  Synthetic Polypeptide
SPKKKRKVEAS

SEQ ID NO: 600 - protein, 84 aa, Artificial Sequence
  Synthetic Polypeptide
MTNLSDIIEKETGKQLVIQESILMLPEEVEEVIGNKPESDILVHTAYDESTDENVMLLTSDAPEYKPWALVIQDSNGENKIKML

SEQ ID NO: 601 - RNA, 82 nt, Artificial Sequence
  Synthetic Polynucleotide
guuuuagagcuagaaauagcaaguuaaaauaaaggcuaguccguuaucaacuugaaaaaguggcaccgagucggugcuuuuu

SEQ ID NO: 602-606 - skipped (5 entries)

SEQ ID NO: 607 - protein, 200 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPYLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLLD

SEQ ID NO: 608 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 609 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 610 - protein, 325 aa, Homo sapiens
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 611 - protein, 1599 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 612 - protein, 1606 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSGGSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 613 - protein, 1599 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 614 - protein, 1605 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 615 - protein, 1612 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 616 - DNA, 80 bp, Artificial Sequence
  Synthetic Polynucleotide
gtaggtagttaggatgaatggaaggttggtatagtcccgcggatttatttatttaatggatgacctctggatccatggac

SEQ ID NO: 617 - DNA, 80 bp, Artificial Sequence
  Synthetic Polynucleotide
gtaggtagttaggatgaatggaaggttggtatagcttccgcggatttatttatttatggatgacctctggatccatggac

SEQ ID NO: 618 - DNA, 80 bp, Artificial Sequence
  Synthetic Polynucleotide
gtaggtagttaggatgaatggaaggttggtatagccttccgcggatttatttattatggatgacctctggatccatggac

SEQ ID NO: 619 - DNA, 80 bp, Artificial Sequence
  Synthetic Polynucleotide
gtaggtagttaggatgaatggaaggttggtatagccattccgcggatttatttatttggatgacctctggatccatggac

SEQ ID NO: 620 - DNA, 80 bp, Artificial Sequence
  Synthetic Polynucleotide
gtaggtagttaggatgaatggaaggttggtatagcctattccgcggatttatttattggatgacctctggatccatggac

SEQ ID NO: 621 - DNA, 80 bp, Artificial Sequence
  Synthetic Polynucleotide
gtaggtagttaggatgaatggaaggttggtatagccttattccgcggatttatttatggatgacctctggatccatggac

SEQ ID NO: 622 - DNA, 80 bp, Artificial Sequence
  Synthetic Polynucleotide
gtaggtagttaggatgaatggaaggttggtatagccattattccgcggatttattttggatgacctctggatccatggac

SEQ ID NO: 623 - DNA, 80 bp, Artificial Sequence
  Synthetic Polynucleotide
gtaggtagttaggatgaatggaaggttggtatagcctattattccgcggatttatttggatgacctctggatccatggac

SEQ ID NO: 624 - DNA, 80 bp, Artificial Sequence
  Synthetic Polynucleotide
gtaggtagttaggatgaatggaaggttggtatagccattatattccgcggatttattggatgacctctggatccatggac

SEQ ID NO: 625 - DNA, 80 bp, Artificial Sequence
  Synthetic Polynucleotide
gtaggtagttaggatgaatggaaggttggtatagcctattatattccgcggatttatggatgacctctggatccatggac

SEQ ID NO: 626 - DNA, 80 bp, Artificial Sequence
  Synthetic Polynucleotide
gtaggtagttaggatgaatggaaggttggtatagccttattatattccgcggattttggatgacctctggatccatggac

SEQ ID NO: 627 - DNA, 80 bp, Artificial Sequence
  Synthetic Polynucleotide
gtaggtagttaggatgaatggaaggttggtatagccattattatattccgcggatttggatgacctctggatccatggac

SEQ ID NO: 628 - DNA, 80 bp, Artificial Sequence
  Synthetic Polynucleotide
gtaggtagttaggatgaatggaaggttggtatagcctattattatattccgcggattggatgacctctggatccatggac

SEQ ID NO: 629 - DNA, 80 bp, Artificial Sequence
  Synthetic Polynucleotide
gtaggtagttaggatgaatggaaggttggtatagccattattattattaccgcggatggatgacctctggatccatggac

SEQ ID NO: 630 - DNA, 80 bp, Artificial Sequence
  Synthetic Polynucleotide
gtaggtagttaggatgaatggaaggttggtatagccattattattattattaccgctggatgacctctggatccatggac

SEQ ID NO: 631 - DNA, 80 bp, Artificial Sequence
  Synthetic Polynucleotide
gtaggtagttaggatgaatggaaggttggtatagtaatattaatttatttatttaatggatgacctctggatccatggac

SEQ ID NO: 632 - DNA, 80 bp, Artificial Sequence; identical to SEQ ID NO: 383
  Synthetic Polynucleotide

SEQ ID NO: 633 - DNA, 80 bp, Artificial Sequence; identical to SEQ ID NO: 622
  Synthetic Polynucleotide

SEQ ID NO: 634 - RNA, 33 nt, Artificial Sequence
  Synthetic Polynucleotide
auuauuccgcggauuuauuuguuuuagagcuag

SEQ ID NO: 635 - RNA, 33 nt, Artificial Sequence
  Synthetic Polynucleotide
cguaggccaggguggucacgguuuuagagcuag

SEQ ID NO: 636 - DNA, 80 bp, Artificial Sequence
  Synthetic Polynucleotide
gtaggtagttaggatgaatggaaggttggtaactatgctgccgcccagtgggactttggaaatacaatgtgtcaactctt

SEQ ID NO: 637 - DNA, 80 bp, Artificial Sequence
  Synthetic Polynucleotide
gtaggtagttaggatgaatggaaggttggtaaaatacaatgtgtcaactcttgacagggctctattttataggcttcttc

SEQ ID NO: 638 - DNA, 80 bp, Artificial Sequence
  Synthetic Polynucleotide
gtaggtagttaggatgaatggaaggttggtattttccatacagtcagtatcaattctggaagaatttccagacattaaag

SEQ ID NO: 639 - DNA, 80 bp, Artificial Sequence
  Synthetic Polynucleotide
gtaggtagttaggatgaatggaaggttggtagcttcggtgtcgaaatgagaagaagaggcacagggctgtgaggcttatc

SEQ ID NO: 640 - DNA, 80 bp, Artificial Sequence
  Synthetic Polynucleotide
gtaggtagttaggatgaatggaaggttggtagtgagcccagaaggggacagtaagaaggaaaaacaggtcagagatggcc

SEQ ID NO: 641 - DNA, 80 bp, Artificial Sequence
  Synthetic Polynucleotide
gtaggtagttaggatgaatggaaggttggtatcctgaacaccttccaggaattctttggcctgaataattgcagtagctc

SEQ ID NO: 642 - DNA, 80 bp, Artificial Sequence
  Synthetic Polynucleotide
gtaggtagttaggatgaatggaaggttggtagacatggaggacgtgcgcggccgcctggtgcagtaccgcggcgaggtgc

SEQ ID NO: 643 - DNA, 80 bp, Artificial Sequence
  Synthetic Polynucleotide
gtaggtagttaggatgaatggaaggttggtactgcagaagcgcctggcagtgtaccaggccggggcccgcgagggcgccg

SEQ ID NO: 644 - DNA, 80 bp, Artificial Sequence
  Synthetic Polynucleotide
gtaggtagttaggatgaatggaaggttggtagccgacaagcagaagaacggcatcaaggtgaacttcaagatccgccaca

SEQ ID NO: 645 - DNA, 80 bp, Artificial Sequence
  Synthetic Polynucleotide
gtaggtagttaggatgaatggaaggttggtaaccactaccagcagaacacccccatcggcgacggccccgtgctgctgcc

SEQ ID NO: 646 - DNA, 81 bp, Artificial Sequence
  Synthetic Polynucleotide
gtaggtagttaggatgaatggaaggttggtacctcgcccttgctcaccatctcgagtcggccgccagtgtgatggatatct

SEQ ID NO: 647 - DNA, 79 bp, Artificial Sequence
  Synthetic Polynucleotide
gtaggtagttaggatgaatggaaggttggtacacgcgtaggccagggtggtcacgagggtgggccagggcacgggcagc

SEQ ID NO: 648 - DNA, 80 bp, Artificial Sequence
  Synthetic Polynucleotide
gtaggtagttaggatgaatggaaggttggtaaagcactgcactccgcaggtcagggtggtcacgagggttggccagggca

SEQ ID NO: 649 - DNA, 80 bp, Artificial Sequence
  Synthetic Polynucleotide
gtaggtagttaggatgaatggaaggttggtacactccgcaggtcagggtggtcacgagggttggccagggcacgggcagg

SEQ ID NO: 650 - DNA, 80 bp, Artificial Sequence
  Synthetic Polynucleotide
gtaggtagttaggatgaatggaaggttggtaggatctcttcttcacggttgcctactggttcaattacttttaaaaatgg

SEQ ID NO: 651 - DNA, 80 bp, Artificial Sequence
  Synthetic Polynucleotide
gtaggtagttaggatgaatggaaggttggtattctcgattgaggatctcttcttcacggttgcctactggttcaattact

SEQ ID NO: 652 - DNA, 80 bp, Artificial Sequence
  Synthetic Polynucleotide
gtaggtagttaggatgaatggaaggttggtaaggagctgtggcagtggcaccagaatggattccagagtccaggtaagac

SEQ ID NO: 653 - DNA, 80 bp, Artificial Sequence
  Synthetic Polynucleotide
gtaggtagttaggatgaatggaaggttggtagtactcctcccggccggcggtatccaggatgtccaacaggcacgtctcc

SEQ ID NO: 654 - DNA, 80 bp, Artificial Sequence
  Synthetic Polynucleotide
gtaggtagttaggatgaatggaaggttggtatgactgcttgcagatggccatggcgcggacgcgggtgccgggcgggggt

SEQ ID NO: 655 - DNA, 80 bp, Artificial Sequence
  Synthetic Polynucleotide
gtaggtagttaggatgaatggaaggttggtactgttacacatgcagttgtagtggatggtggtacagtcagagccaacct

SEQ ID NO: 656 - DNA, 80 bp, Artificial Sequence
  Synthetic Polynucleotide
gtaggtagttaggatgaatggaaggttggtaggaactgtcacacatgtagttgtagtggatggtggtacagtcagagcca

SEQ ID NO: 657 - protein, 1623 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 658 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 659 - DNA, 23 bp, Artificial Sequence
  Synthetic Polynucleotide
cacccagactgagcacgtgctgg

SEQ ID NO: 660 - DNA, 23 bp, Artificial Sequence
  Synthetic Polynucleotide
gacacagactgggcacgtgaggg

SEQ ID NO: 661 - DNA, 23 bp, Artificial Sequence
  Synthetic Polynucleotide
agctcagactgagcaagtgaggg

SEQ ID NO: 662 - DNA, 23 bp, Artificial Sequence
  Synthetic Polynucleotide
agaccagactgagcaagagaggg

SEQ ID NO: 663 - DNA, 23 bp, Artificial Sequence
  Synthetic Polynucleotide
gagccagaatgagcacgtgaggg

SEQ ID NO: 664 - DNA, 23 bp, Artificial Sequence
  Synthetic Polynucleotide
tgcactgcggccggaggaggtgg

SEQ ID NO: 665 - DNA, 23 bp, Artificial Sequence
  Synthetic Polynucleotide
ggctctgcggctggagggggtgg

SEQ ID NO: 666 - DNA, 23 bp, Artificial Sequence
  Synthetic Polynucleotide
ggcacgacggctggaggtggggg

SEQ ID NO: 667 - DNA, 23 bp, Artificial Sequence
  Synthetic Polynucleotide
ggcatcacggctggaggtggagg

SEQ ID NO: 668 - DNA, 23 bp, Artificial Sequence
  Synthetic Polynucleotide
ggcgctgcggcgggaggtggagg

SEQ ID NO: 669 - DNA, 23 bp, Artificial Sequence
  Synthetic Polynucleotide
ggcactgagactgggggtggggg

SEQ ID NO: 670 - DNA, 23 bp, Artificial Sequence
  Synthetic Polynucleotide
agcagtgcggctagaggtggtgg

SEQ ID NO: 671 - DNA, 23 bp, Artificial Sequence
  Synthetic Polynucleotide
ggcactgctactgggggtggtgg

SEQ ID NO: 672 - DNA, 23 bp, Artificial Sequence
  Synthetic Polynucleotide
ggcactggggctgggggaggggg

SEQ ID NO: 673 - DNA, 23 bp, Artificial Sequence
  Synthetic Polynucleotide
ggcactggggttggaggtggggg

SEQ ID NO: 674 - protein, 1368 aa, Artificial Sequence; identical to SEQ ID NO: 4
  Synthetic Polypeptide

SEQ ID NO: 675 - protein, 7 aa, Artificial Sequence
  Synthetic Polypeptide
KRLAVYQ

SEQ ID NO: 676-677 - skipped (2 entries)

SEQ ID NO: 678 - protein, 7 aa, Artificial Sequence
  Synthetic Polypeptide
RAMAICK

SEQ ID NO: 679-683 - skipped (5 entries)

SEQ ID NO: 684 - DNA, 23 bp, Artificial Sequence
  Synthetic Polynucleotide
tcagggtgagcatagactgccgg

SEQ ID NO: 685 - DNA, 23 bp, Artificial Sequence
  Synthetic Polynucleotide
gaatcgggaggggagactgcggg

SEQ ID NO: 686 - DNA, 23 bp, Artificial Sequence
  Synthetic Polynucleotide
tgaagtgttgcatagactgcagg

SEQ ID NO: 687 - DNA, 23 bp, Artificial Sequence
  Synthetic Polynucleotide
ggagagagagcatagactgctgg

SEQ ID NO: 688 - DNA, 23 bp, Artificial Sequence
  Synthetic Polynucleotide
ccaaacaaaacatagactgctgg

SEQ ID NO: 689-694 - skipped (6 entries)

SEQ ID NO: 695 - DNA, 23 bp, Artificial Sequence
  Synthetic Polynucleotide
caggaagctggagcacgtgaggg

SEQ ID NO: 696 - DNA, 23 bp, Artificial Sequence
  Synthetic Polynucleotide
aaggctgagggagcacgtgaagg

SEQ ID NO: 697 - DNA, 23 bp, Artificial Sequence
  Synthetic Polynucleotide
gtcaggggaagagcacgtgacgg

SEQ ID NO: 698 - DNA, 23 bp, Artificial Sequence
  Synthetic Polynucleotide
gttgtgaactgagcacgtgaggg

SEQ ID NO: 699 - DNA, 23 bp, Artificial Sequence
  Synthetic Polynucleotide
atatttgctggagcacgtgaagg

SEQ ID NO: 700-712 - skipped (13 entries)

SEQ ID NO: 713 - DNA, 25 bp, Artificial Sequence
  Synthetic Polynucleotide
cacctgcgcaagctgcgtaagcggc

SEQ ID NO: 714 - DNA, 25 bp, Artificial Sequence
  Synthetic Polynucleotide
tcctccgcgatgccgatgacctgca

SEQ ID NO: 715 - DNA, 25 bp, Artificial Sequence
  Synthetic Polynucleotide
aggccggggcccgcgagggcgccga

SEQ ID NO: 716 - DNA, 25 bp, Artificial Sequence
  Synthetic Polynucleotide
gcgcggcctcagcgccatccgcgag

SEQ ID NO: 717 - DNA, 25 bp, Artificial Sequence
  Synthetic Polynucleotide
cctgtgcagctgtgggttgattcca

SEQ ID NO: 718 - DNA, 25 bp, Artificial Sequence
  Synthetic Polynucleotide
cacccccgcccggcacccgcgtccg

SEQ ID NO: 719 - DNA, 25 bp, Artificial Sequence
  Synthetic Polynucleotide
agtcacagcacatgacggaggttgt

SEQ ID NO: 720 - DNA, 25 bp, Artificial Sequence
  Synthetic Polynucleotide
gaggcgctgcccccaccatgagcgc

SEQ ID NO: 721-740 - skipped (20 entries)

SEQ ID NO: 741 - protein, 7 aa, Artificial Sequence
  Synthetic Polypeptide
PKKKRKV

SEQ ID NO: 742 - protein, 30 aa, Artificial Sequence
  Synthetic Polypeptide
MDSLLMNRRKFLYQFKNVRWAKGRRETYLC

SEQ ID NO: 743 - DNA, 200 bp, Artificial Sequence
  Synthetic Polynucleotide
agcaccgaggagctgcgggtgcgcctcgcctcccacctgcgcaagctgcgtaagcggctcctccgcgatgccgatgacctgcagaagtgcctggcagtgtaccaggccggggcccgcgagggcgccgagcgcggcctcagcgccatccgcgagcgcctggggcccctggtggaacagggccgcgtgcgggccgccactgt

SEQ ID NO: 744 - DNA, 200 bp, Artificial Sequence
  Synthetic Polynucleotide
acagtggcggcccgcacgcggccctgttccaccaggggccccaggcgctcgcggatggcgctgaggccgcgctcggcgccctcgcgggccccggcctggtacactgccaggcacttctgcaggtcatcggcatcgcggaggagccgcttacgcagcttgcgcaggtgggaggcgaggcgcacccgcagctcctcggtgct

SEQ ID NO: 745 - DNA, 200 bp, Artificial Sequence
  Synthetic Polynucleotide
actcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctg

SEQ ID NO: 746 - DNA, 200 bp, Artificial Sequence
  Synthetic Polynucleotide
cagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagt

SEQ ID NO: 747 - DNA, 23 bp, Artificial Sequence
  Synthetic Polynucleotide
tttytttttttttttttttgagg

SEQ ID NO: 748 - DNA, 23 bp, Artificial Sequence
  Synthetic Polynucleotide
tttgyggtggagaggggcttcgg

SEQ ID NO: 749 - DNA, 23 bp, Artificial Sequence
  Synthetic Polynucleotide
ttgyggtggagaggggcttcggg

SEQ ID NO: 750 - DNA, 23 bp, Artificial Sequence
  Synthetic Polynucleotide
ttgytaataaaagttagaaacgg

SEQ ID NO: 751 - DNA, 23 bp, Artificial Sequence
  Synthetic Polynucleotide
ttgayagggagcaagcagttcgg

SEQ ID NO: 752 - DNA, 23 bp, Artificial Sequence
  Synthetic Polynucleotide
tgayagggagcaagcagttcggg

SEQ ID NO: 753 - DNA, 23 bp, Artificial Sequence
  Synthetic Polynucleotide
ttcygtaaaacataaaagtcagg

SEQ ID NO: 754 - DNA, 23 bp, Artificial Sequence
  Synthetic Polynucleotide
ttcyggtttgtcttatattctgg

SEQ ID NO: 755 - DNA, 23 bp, Artificial Sequence
  Synthetic Polynucleotide
cttcyatgatcttcgaggagagg

SEQ ID NO: 756 - DNA, 23 bp, Artificial Sequence
  Synthetic Polynucleotide
ttcgtggyggaagctcctcacgg

SEQ ID NO: 757 - DNA, 23 bp, Artificial Sequence
  Synthetic Polynucleotide
cttcaytgtggtcattttcctgg

SEQ ID NO: 758 - DNA, 23 bp, Artificial Sequence
  Synthetic Polynucleotide
ttcaytgtggtcattttcctggg

SEQ ID NO: 759 - DNA, 23 bp, Artificial Sequence
  Synthetic Polynucleotide
ttcagygtattgctttgaggagg

SEQ ID NO: 760 - DNA, 23 bp, Artificial Sequence
  Synthetic Polynucleotide
ttaagttytatgcgattaccggg

SEQ ID NO: 761 - DNA, 23 bp, Artificial Sequence
  Synthetic Polynucleotide
tgtgttygcgcagggagctcggg

SEQ ID NO: 762 - DNA, 23 bp, Artificial Sequence
  Synthetic Polynucleotide
atgtgttygcgcagggagctcgg

SEQ ID NO: 763 - DNA, 23 bp, Artificial Sequence
  Synthetic Polynucleotide
tgtggyggccatggcctatgagg

SEQ ID NO: 764 - DNA, 23 bp, Artificial Sequence
  Synthetic Polynucleotide
tgtgayggacagagcacaaatgg

SEQ ID NO: 765 - DNA, 23 bp, Artificial Sequence
  Synthetic Polynucleotide
tgtagyaggtgaagatgatcagg

SEQ ID NO: 766 - DNA, 23 bp, Artificial Sequence
  Synthetic Polynucleotide
tgtaatayttctgatcatgttgg

SEQ ID NO: 767 - DNA, 23 bp, Artificial Sequence
  Synthetic Polynucleotide
tggyagaggcccctggggtcagg

SEQ ID NO: 768 - DNA, 23 bp, Artificial Sequence
  Synthetic Polynucleotide
tggyaagttctcccctcaacagg

SEQ ID NO: 769 - DNA, 23 bp, Artificial Sequence
  Synthetic Polynucleotide
tggttyggcatcatagtgctggg

SEQ ID NO: 770 - DNA, 23 bp, Artificial Sequence
  Synthetic Polynucleotide
gtggttyggcatcatagtgctgg

SEQ ID NO: 771 - DNA, 23 bp, Artificial Sequence
  Synthetic Polynucleotide
tggggaayatacgtgcttggcgg

SEQ ID NO: 772 - DNA, 23 bp, Artificial Sequence
  Synthetic Polynucleotide
ggggaayatacgtgcttggcggg

SEQ ID NO: 773 - DNA, 23 bp, Artificial Sequence
  Synthetic Polynucleotide
gagtygcaccaaaatttttgggg

SEQ ID NO: 774 - DNA, 23 bp, Artificial Sequence
  Synthetic Polynucleotide
ggagtygcaccaaaatttttggg

SEQ ID NO: 775 - DNA, 23 bp, Artificial Sequence
  Synthetic Polynucleotide
tggagtygcaccaaaatttttgg

SEQ ID NO: 776 - DNA, 23 bp, Artificial Sequence
  Synthetic Polynucleotide
tggaagytatcgatgaccacagg

SEQ ID NO: 777 - DNA, 23 bp, Artificial Sequence
  Synthetic Polynucleotide
tgcyggtggccgacgtgaagcgg

SEQ ID NO: 778 - DNA, 23 bp, Artificial Sequence
  Synthetic Polynucleotide
tgcyaaaagacccaaaacaaagg

SEQ ID NO: 779 - DNA, 23 bp, Artificial Sequence
  Synthetic Polynucleotide
tgctygatccactggatgtgggg

SEQ ID NO: 780 - DNA, 23 bp, Artificial Sequence
  Synthetic Polynucleotide
gtgctygatccactggatgtggg

SEQ ID NO: 781 - DNA, 23 bp, Artificial Sequence
  Synthetic Polynucleotide
cgtgctygatccactggatgtgg

SEQ ID NO: 782 - DNA, 23 bp, Artificial Sequence
  Synthetic Polynucleotide
tgctgaytggaaaccgtgagtgg

SEQ ID NO: 783 - DNA, 23 bp, Artificial Sequence
  Synthetic Polynucleotide
gtgcggyatttgtcctgctccgg

SEQ ID NO: 784 - DNA, 23 bp, Artificial Sequence
  Synthetic Polynucleotide
tgcggyatttgtcctgctccggg

SEQ ID NO: 785 - DNA, 23 bp, Artificial Sequence
  Synthetic Polynucleotide
tgcggagyggacgggcagcgtgg

SEQ ID NO: 786 - DNA, 23 bp, Artificial Sequence
  Synthetic Polynucleotide
gcgaytgcagaagatgacctggg

SEQ ID NO: 787 - DNA, 23 bp, Artificial Sequence
  Synthetic Polynucleotide
tgcgaytgcagaagatgacctgg

SEQ ID NO: 788 - DNA, 23 bp, Artificial Sequence
  Synthetic Polynucleotide
gcayggtctctcgggcgctgggg

SEQ ID NO: 789 - DNA, 23 bp, Artificial Sequence
  Synthetic Polynucleotide
tgcayggtctctcgggcgctggg

SEQ ID NO: 790 - DNA, 23 bp, Artificial Sequence
  Synthetic Polynucleotide
ctgcayggtctctcgggcgctgg

SEQ ID NO: 791 - DNA, 23 bp, Artificial Sequence
  Synthetic Polynucleotide
tgcagyagccgcccttctgccgg

SEQ ID NO: 792 - DNA, 23 bp, Artificial Sequence
  Synthetic Polynucleotide
tgayggaggggatggcgcctagg

SEQ ID NO: 793 - DNA, 23 bp, Artificial Sequence
  Synthetic Polynucleotide
tgatgygaggctgccgccgcagg

SEQ ID NO: 794 - DNA, 23 bp, Artificial Sequence
  Synthetic Polynucleotide
tgagyatgcataagcgacgaagg

SEQ ID NO: 795 - DNA, 23 bp, Artificial Sequence
  Synthetic Polynucleotide
tgagtytgagagccggctggcgg

SEQ ID NO: 796 - DNA, 23 bp, Artificial Sequence
  Synthetic Polynucleotide
tgagtaygcataagcgacgaagg

SEQ ID NO: 797 - DNA, 23 bp, Artificial Sequence
  Synthetic Polynucleotide
tgaggyaatcagccaggatctgg

SEQ ID NO: 798 - DNA, 23 bp, Artificial Sequence
  Synthetic Polynucleotide
tgagayggcccacctgggcttgg

SEQ ID NO: 799 - DNA, 23 bp, Artificial Sequence
  Synthetic Polynucleotide
gagayggcccacctgggcttggg

SEQ ID NO: 800 - DNA, 23 bp, Artificial Sequence
  Synthetic Polynucleotide
tctyggagggcgaggaggagagg

SEQ ID NO: 801 - DNA, 23 bp, Artificial Sequence
  Synthetic Polynucleotide
tctygatggccacgtcgtactgg

SEQ ID NO: 802 - DNA, 23 bp, Artificial Sequence
  Synthetic Polynucleotide
tctttaytgtttaagccaacagg

SEQ ID NO: 803 - DNA, 23 bp, Artificial Sequence
  Synthetic Polynucleotide
tctgyggaccaaaatcattctgg

SEQ ID NO: 804 - DNA, 23 bp, Artificial Sequence
  Synthetic Polynucleotide
tctggytgatactcaagtccagg

SEQ ID NO: 805 - DNA, 23 bp, Artificial Sequence
  Synthetic Polynucleotide
tccyagtaagaaacagaatatgg

SEQ ID NO: 806 - DNA, 23 bp, Artificial Sequence
  Synthetic Polynucleotide
tccyaaaaggcacgggatgaagg

SEQ ID NO: 807 - DNA, 23 bp, Artificial Sequence
  Synthetic Polynucleotide
tccaytgtggcccaggaaggagg

SEQ ID NO: 808 - DNA, 23 bp, Artificial Sequence
  Synthetic Polynucleotide
cgctccaytgtggcccaggaagg

SEQ ID NO: 809 - DNA, 23 bp, Artificial Sequence
  Synthetic Polynucleotide
tccayggtcaagtcagcctcagg

SEQ ID NO: 810 - DNA, 23 bp, Artificial Sequence
  Synthetic Polynucleotide
ccayggtcaagtcagcctcaggg

SEQ ID NO: 811 - DNA, 23 bp, Artificial Sequence
  Synthetic Polynucleotide
ctccayggagttccctggcctgg

SEQ ID NO: 812 - DNA, 23 bp, Artificial Sequence
  Synthetic Polynucleotide
tccayggagttccctggcctggg

SEQ ID NO: 813 - DNA, 23 bp, Artificial Sequence
  Synthetic Polynucleotide
ccayggagttccctggcctgggg

SEQ ID NO: 814 - DNA, 23 bp, Artificial Sequence
  Synthetic Polynucleotide
tccayagatgaagttattgcagg

SEQ ID NO: 815 - DNA, 23 bp, Artificial Sequence
  Synthetic Polynucleotide
ctccagyaagttataaaatttgg

SEQ ID NO: 816 - DNA, 23 bp, Artificial Sequence
  Synthetic Polynucleotide
tccagyaagttataaaatttggg

SEQ ID NO: 817 - DNA, 23 bp, Artificial Sequence
  Synthetic Polynucleotide
tccaggygcgggcgtcatgctgg

SEQ ID NO: 818 - DNA, 23 bp, Artificial Sequence
  Synthetic Polynucleotide
ccaggygcgggcgtcatgctggg

SEQ ID NO: 819 - DNA, 23 bp, Artificial Sequence
  Synthetic Polynucleotide
tcaytgataagcagggcccaggg

SEQ ID NO: 820 - DNA, 23 bp, Artificial Sequence
  Synthetic Polynucleotide
ttcaytgataagcagggcccagg

SEQ ID NO: 821 - DNA, 23 bp, Artificial Sequence
  Synthetic Polynucleotide
tcayggtgagttaaggacagtgg

SEQ ID NO: 822 - DNA, 23 bp, Artificial Sequence
  Synthetic Polynucleotide
tcatattyacaggcttgtaaagg

SEQ ID NO: 823 - DNA, 23 bp, Artificial Sequence
  Synthetic Polynucleotide
catagtyctgcagaggagagggg

SEQ ID NO: 824 - DNA, 23 bp, Artificial Sequence
  Synthetic Polynucleotide
tcatagtyctgcagaggagaggg

SEQ ID NO: 825 - DNA, 23 bp, Artificial Sequence
  Synthetic Polynucleotide
tcagaagyttttttcttcgcagg

SEQ ID NO: 826 - DNA, 23 bp, Artificial Sequence
  Synthetic Polynucleotide
tcaagtgygtccttccggagcgg

SEQ ID NO: 827 - DNA, 23 bp, Artificial Sequence
  Synthetic Polynucleotide
caagtgygtccttccggagcggg

SEQ ID NO: 828 - DNA, 23 bp, Artificial Sequence
  Synthetic Polynucleotide
aagtgygtccttccggagcgggg

SEQ ID NO: 829 - DNA, 23 bp, Artificial Sequence
  Synthetic Polynucleotide
agtgygtccttccggagcggggg

SEQ ID NO: 830 - DNA, 23 bp, Artificial Sequence
  Synthetic Polynucleotide
tacygtgggcagagaaggggagg

SEQ ID NO: 831 - DNA, 23 bp, Artificial Sequence
  Synthetic Polynucleotide
aggtacygtgggcagagaagggg

SEQ ID NO: 832 - DNA, 23 bp, Artificial Sequence
  Synthetic Polynucleotide
caggtacygtgggcagagaaggg

SEQ ID NO: 833 - DNA, 23 bp, Artificial Sequence
  Synthetic Polynucleotide
taaytgtgcccatggccatttgg

SEQ ID NO: 834 - DNA, 23 bp, Artificial Sequence
  Synthetic Polynucleotide
taaatgaytgagtttgcccttgg

SEQ ID NO: 835 - DNA, 23 bp, Artificial Sequence
  Synthetic Polynucleotide
gttataygtgccaatgtgactgg

SEQ ID NO: 836 - DNA, 23 bp, Artificial Sequence
  Synthetic Polynucleotide
gtgtgtayagatgtccagaaggg

SEQ ID NO: 837 - DNA, 23 bp, Artificial Sequence
  Synthetic Polynucleotide
gtcytaggccccaaaaattttgg

SEQ ID NO: 838 - DNA, 23 bp, Artificial Sequence
  Synthetic Polynucleotide
gtcgagaygctggccagctacgg

SEQ ID NO: 839 - DNA, 23 bp, Artificial Sequence
  Synthetic Polynucleotide
tcgagaygctggccagctacggg

SEQ ID NO: 840 - DNA, 23 bp, Artificial Sequence
  Synthetic Polynucleotide
gtcaytgaggttctgcatggtgg

SEQ ID NO: 841 - DNA, 23 bp, Artificial Sequence
  Synthetic Polynucleotide
gcggtcaytgaggttctgcatgg

SEQ ID NO: 842 - DNA, 23 bp, Artificial Sequence
  Synthetic Polynucleotide
gtcaygaaaaagccaagatgcgg

SEQ ID NO: 843 - DNA, 23 bp, Artificial Sequence
  Synthetic Polynucleotide
tcaygaaaaagccaagatgcggg

SEQ ID NO: 844 - DNA, 23 bp, Artificial Sequence
  Synthetic Polynucleotide
gtcayagttctggcacgttttgg

SEQ ID NO: 845 - DNA, 23 bp, Artificial Sequence
  Synthetic Polynucleotide
gtayagaggtattgttcttttgg

SEQ ID NO: 846 - DNA, 23 bp, Artificial Sequence
  Synthetic Polynucleotide
gtagyaggcccaagcccgacagg

SEQ ID NO: 847 - DNA, 23 bp, Artificial Sequence
  Synthetic Polynucleotide
gtaagtgytgaccaaattaccgg

SEQ ID NO: 848 - DNA, 23 bp, Artificial Sequence
  Synthetic Polynucleotide
ggtygggagggaaaagacattgg

SEQ ID NO: 849 - DNA, 23 bp, Artificial Sequence
  Synthetic Polynucleotide
ggttayggtgccgttaagtttgg

SEQ ID NO: 850 - DNA, 23 bp, Artificial Sequence
  Synthetic Polynucleotide
ggtgttgytggaatggagaatgg

SEQ ID NO: 851 - DNA, 23 bp, Artificial Sequence
  Synthetic Polynucleotide
gggattgytgttcatgaattggg

SEQ ID NO: 852 - DNA, 23 bp, Artificial Sequence
  Synthetic Polynucleotide
ggcyatatacaactacgcaaagg

SEQ ID NO: 853 - DNA, 23 bp, Artificial Sequence
  Synthetic Polynucleotide
gggcyagaaatctgttgctatgg

SEQ ID NO: 854 - DNA, 23 bp, Artificial Sequence
  Synthetic Polynucleotide
ggcyagaaatctgttgctatggg

SEQ ID NO: 855 - DNA, 23 bp, Artificial Sequence
  Synthetic Polynucleotide
ggctgytgttggccagcagaagg

SEQ ID NO: 856 - DNA, 23 bp, Artificial Sequence
  Synthetic Polynucleotide
ggctgatyacctcacgctccagg

SEQ ID NO: 857 - DNA, 23 bp, Artificial Sequence
  Synthetic Polynucleotide
gatyacctcacgctccaggttgg

SEQ ID NO: 858 - DNA, 23 bp, Artificial Sequence
  Synthetic Polynucleotide
ggcatagyggaagatctatgagg

SEQ ID NO: 859 - DNA, 23 bp, Artificial Sequence
  Synthetic Polynucleotide
ggcaagygcatcaacacgctggg

SEQ ID NO: 860 - DNA, 23 bp, Artificial Sequence
  Synthetic Polynucleotide
gggcaagygcatcaacacgctgg

SEQ ID NO: 861 - DNA, 23 bp, Artificial Sequence
  Synthetic Polynucleotide
ggataayatcaaacacgtcccgg

SEQ ID NO: 862 - DNA, 23 bp, Artificial Sequence
  Synthetic Polynucleotide
gataayatcaaacacgtcccggg

SEQ ID NO: 863 - DNA, 23 bp, Artificial Sequence
  Synthetic Polynucleotide
ggagyaggggctcagcagggcgg

SEQ ID NO: 864 - DNA, 23 bp, Artificial Sequence
  Synthetic Polynucleotide
ataggagyaggggctcagcaggg

SEQ ID NO: 865 - DNA, 23 bp, Artificial Sequence
  Synthetic Polynucleotide
ggaggyaataactttgtaagtgg

SEQ ID NO: 866 - DNA, 23 bp, Artificial Sequence
  Synthetic Polynucleotide
ggagayggcctccatgaaggagg

SEQ ID NO: 867 - DNA, 23 bp, Artificial Sequence
  Synthetic Polynucleotide
ggaagyggcgtgctgtgctgagg

SEQ ID NO: 868 - DNA, 23 bp, Artificial Sequence
  Synthetic Polynucleotide
ggaagyagtggtggaagtagagg

SEQ ID NO: 869 - DNA, 23 bp, Artificial Sequence
  Synthetic Polynucleotide
gcttttyttcaagctgcccaagg

SEQ ID NO: 870 - DNA, 23 bp, Artificial Sequence
  Synthetic Polynucleotide
gcttgyagatggccatggcgcgg

SEQ ID NO: 871 - DNA, 23 bp, Artificial Sequence
  Synthetic Polynucleotide
gctgtyggccgccggctccgcgg

SEQ ID NO: 872 - DNA, 23 bp, Artificial Sequence
  Synthetic Polynucleotide
cggytggccttgggattgagggg

SEQ ID NO: 873 - DNA, 23 bp, Artificial Sequence
  Synthetic Polynucleotide
gcggytggccttgggattgaggg

SEQ ID NO: 874 - DNA, 23 bp, Artificial Sequence
  Synthetic Polynucleotide
cgcggytggccttgggattgagg

SEQ ID NO: 875 - DNA, 23 bp, Artificial Sequence
  Synthetic Polynucleotide
gccyggggaaaaacagagtcagg

SEQ ID NO: 876 - DNA, 23 bp, Artificial Sequence
  Synthetic Polynucleotide
gccygaaaacacagccacagagg

SEQ ID NO: 877 - DNA, 23 bp, Artificial Sequence
  Synthetic Polynucleotide
gccgggygttggtctgtctctgg

SEQ ID NO: 878 - DNA, 23 bp, Artificial Sequence
  Synthetic Polynucleotide
gccaggyggaagtcatagagcgg

SEQ ID NO: 879 - DNA, 23 bp, Artificial Sequence
  Synthetic Polynucleotide
gccagayactttgtgaagtaagg

SEQ ID NO: 880 - DNA, 23 bp, Artificial Sequence
  Synthetic Polynucleotide
ccagayactttgtgaagtaaggg

SEQ ID NO: 881 - DNA, 23 bp, Artificial Sequence
  Synthetic Polynucleotide
gccagagygagtggctggagtgg

SEQ ID NO: 882 - DNA, 23 bp, Artificial Sequence
  Synthetic Polynucleotide
gccaayggtaacgggcctttggg

SEQ ID NO: 883 - DNA, 23 bp, Artificial Sequence
  Synthetic Polynucleotide
agccaayggtaacgggcctttgg

SEQ ID NO: 884 - DNA, 23 bp, Artificial Sequence
  Synthetic Polynucleotide
gcatgyttgctccaacacagagg

SEQ ID NO: 885 - DNA, 23 bp, Artificial Sequence
  Synthetic Polynucleotide
caagcagygtgagctgctcctgg

SEQ ID NO: 886 - DNA, 23 bp, Artificial Sequence
  Synthetic Polynucleotide
gcagygtgagctgctcctggagg

SEQ ID NO: 887 - DNA, 23 bp, Artificial Sequence
  Synthetic Polynucleotide
gcagtggyaggtgatgttctggg

SEQ ID NO: 888 - DNA, 23 bp, Artificial Sequence
  Synthetic Polynucleotide
gcaggyagagatgaccgctgtgg

SEQ ID NO: 889 - DNA, 23 bp, Artificial Sequence
  Synthetic Polynucleotide
gcaggtyaccatctcctggaggg

SEQ ID NO: 890 - DNA, 23 bp, Artificial Sequence
  Synthetic Polynucleotide
tgcaggtyaccatctcctggagg

SEQ ID NO: 891 - DNA, 23 bp, Artificial Sequence
  Synthetic Polynucleotide
gcaaataygctatctgtagcagg

SEQ ID NO: 892 - DNA, 23 bp, Artificial Sequence
  Synthetic Polynucleotide
gattayatctgtagccttcgggg

SEQ ID NO: 893 - DNA, 23 bp, Artificial Sequence
  Synthetic Polynucleotide
agattayatctgtagccttcggg

SEQ ID NO: 894 - DNA, 23 bp, Artificial Sequence
  Synthetic Polynucleotide
gagattayatctgtagccttcgg

SEQ ID NO: 895 - DNA, 23 bp, Artificial Sequence
  Synthetic Polynucleotide
gatggyagttaatgagctcaggg

SEQ ID NO: 896 - DNA, 23 bp, Artificial Sequence
  Synthetic Polynucleotide
tgatggyagttaatgagctcagg

SEQ ID NO: 897 - DNA, 23 bp, Artificial Sequence
  Synthetic Polynucleotide
gatgaggyagatgcacacaaagg

SEQ ID NO: 898 - DNA, 23 bp, Artificial Sequence
  Synthetic Polynucleotide
gataggyacatatcaaaccaggg

SEQ ID NO: 899 - DNA, 23 bp, Artificial Sequence
  Synthetic Polynucleotide
agataggyacatatcaaaccagg

SEQ ID NO: 900 - DNA, 23 bp, Artificial Sequence
  Synthetic Polynucleotide
gagaytggaaattttggccgtgg

SEQ ID NO: 901 - DNA, 23 bp, Artificial Sequence
  Synthetic Polynucleotide
gataytcacaattacaactgggg

SEQ ID NO: 902 - DNA, 23 bp, Artificial Sequence
  Synthetic Polynucleotide
agataytcacaattacaactggg

SEQ ID NO: 903 - DNA, 23 bp, Artificial Sequence
  Synthetic Polynucleotide
gagataytcacaattacaactgg

SEQ ID NO: 904 - DNA, 23 bp, Artificial Sequence
  Synthetic Polynucleotide
gagaggygagaagagggaagcgg

SEQ ID NO: 905 - DNA, 23 bp, Artificial Sequence
  Synthetic Polynucleotide
gagaagaygacccaggtgagtgg

SEQ ID NO: 906 - DNA, 23 bp, Artificial Sequence
  Synthetic Polynucleotide
gacttygagttcagacatgaggg

SEQ ID NO: 907 - DNA, 23 bp, Artificial Sequence
  Synthetic Polynucleotide
ggacttygagttcagacatgagg

SEQ ID NO: 908 - DNA, 23 bp, Artificial Sequence
  Synthetic Polynucleotide
gacaytgatgaatgtcgctatgg

SEQ ID NO: 909 - DNA, 23 bp, Artificial Sequence
  Synthetic Polynucleotide
gacayggtagatgatcagcgggg

SEQ ID NO: 910 - DNA, 23 bp, Artificial Sequence
  Synthetic Polynucleotide
tgacayggtagatgatcagcggg

SEQ ID NO: 911 - DNA, 23 bp, Artificial Sequence
  Synthetic Polynucleotide
atgacayggtagatgatcagcgg

SEQ ID NO: 912 - DNA, 23 bp, Artificial Sequence
  Synthetic Polynucleotide
gacaygaagggagatgctgaggg

SEQ ID NO: 913 - DNA, 23 bp, Artificial Sequence
  Synthetic Polynucleotide
agacaygaagggagatgctgagg

SEQ ID NO: 914 - DNA, 23 bp, Artificial Sequence
  Synthetic Polynucleotide
gacatytggagggtccccgatgg

SEQ ID NO: 915 - DNA, 23 bp, Artificial Sequence
  Synthetic Polynucleotide
gacagagytcctccacaacatgg

SEQ ID NO: 916 - DNA, 23 bp, Artificial Sequence
  Synthetic Polynucleotide
gaayatataccaaggtatcccgg

SEQ ID NO: 917 - DNA, 23 bp, Artificial Sequence
  Synthetic Polynucleotide
gaatgtaygataatgaacggagg

SEQ ID NO: 918 - DNA, 23 bp, Artificial Sequence
  Synthetic Polynucleotide
gaagtaayaggtgaccccagggg

SEQ ID NO: 919 - DNA, 23 bp, Artificial Sequence
  Synthetic Polynucleotide
gaaggygtggtagggaggcacgg

SEQ ID NO: 920 - DNA, 23 bp, Artificial Sequence
  Synthetic Polynucleotide
aaggygtggtagggaggcacggg

SEQ ID NO: 921 - DNA, 23 bp, Artificial Sequence
  Synthetic Polynucleotide
aggygtggtagggaggcacgggg

SEQ ID NO: 922 - DNA, 23 bp, Artificial Sequence
  Synthetic Polynucleotide
gaaataygatggggcgctcaggg

SEQ ID NO: 923 - DNA, 23 bp, Artificial Sequence
  Synthetic Polynucleotide
agaaataygatggggcgctcagg

SEQ ID NO: 924 - DNA, 23 bp, Artificial Sequence
  Synthetic Polynucleotide
cttgygttatgatggattcatgg

SEQ ID NO: 925 - DNA, 23 bp, Artificial Sequence
  Synthetic Polynucleotide
cttayagatctcatcaatgttgg

SEQ ID NO: 926 - DNA, 23 bp, Artificial Sequence
  Synthetic Polynucleotide
cttaggyaagtaatgcaatatgg

SEQ ID NO: 927 - DNA, 23 bp, Artificial Sequence
  Synthetic Polynucleotide
ctgyggatgcactggggtgcggg

SEQ ID NO: 928 - DNA, 23 bp, Artificial Sequence
  Synthetic Polynucleotide
tctgyggatgcactggggtgcgg

SEQ ID NO: 929 - DNA, 23 bp, Artificial Sequence
  Synthetic Polynucleotide
ctgtgyaagtaatacaactttgg

SEQ ID NO: 930 - DNA, 23 bp, Artificial Sequence
  Synthetic Polynucleotide
ctgtgtgygccagggctgtgggg

SEQ ID NO: 931 - DNA, 23 bp, Artificial Sequence
  Synthetic Polynucleotide
ctgtgagygtgcccaggggcggg

SEQ ID NO: 932 - DNA, 23 bp, Artificial Sequence
  Synthetic Polynucleotide
tgagygtgcccaggggcgggcgg

SEQ ID NO: 933 - DNA, 23 bp, Artificial Sequence
  Synthetic Polynucleotide
ctggyaaaaaacctggtttttgg

SEQ ID NO: 934 - DNA, 23 bp, Artificial Sequence
  Synthetic Polynucleotide
tggyaaaaaacctggtttttggg

SEQ ID NO: 935 - DNA, 23 bp, Artificial Sequence
  Synthetic Polynucleotide
tgatyttcagcctccttttgggg

SEQ ID NO: 936 - DNA, 23 bp, Artificial Sequence
  Synthetic Polynucleotide
ctgatyttcagcctccttttggg

SEQ ID NO: 937 - DNA, 23 bp, Artificial Sequence
  Synthetic Polynucleotide
gctgatyttcagcctccttttgg

SEQ ID NO: 938 - DNA, 23 bp, Artificial Sequence
  Synthetic Polynucleotide
ctgaagytggtctgacctcaggg

SEQ ID NO: 939 - DNA, 23 bp, Artificial Sequence
  Synthetic Polynucleotide
gctgaagytggtctgacctcagg

SEQ ID NO: 940 - DNA, 23 bp, Artificial Sequence
  Synthetic Polynucleotide
ctcytgatgttgttgtgagctgg

SEQ ID NO: 941 - DNA, 23 bp, Artificial Sequence
  Synthetic Polynucleotide
ctcyagggccgcaggttggaggg

SEQ ID NO: 942 - DNA, 23 bp, Artificial Sequence
  Synthetic Polynucleotide
gctcyagggccgcaggttggagg

SEQ ID NO: 943 - DNA, 23 bp, Artificial Sequence
  Synthetic Polynucleotide
ggcgctcyagggccgcaggttgg

SEQ ID NO: 944 - DNA, 23 bp, Artificial Sequence
  Synthetic Polynucleotide
ctcayggttggttggcaagaagg

SEQ ID NO: 945 - DNA, 23 bp, Artificial Sequence
  Synthetic Polynucleotide
ctcaygatctgggatctcagagg

SEQ ID NO: 946 - DNA, 23 bp, Artificial Sequence
  Synthetic Polynucleotide
ctcayaggccattgcgaccacgg

SEQ ID NO: 947 - DNA, 23 bp, Artificial Sequence
  Synthetic Polynucleotide
ctcaayagatgccatctccctgg

SEQ ID NO: 948 - DNA, 23 bp, Artificial Sequence
  Synthetic Polynucleotide
ctataytgttcatcccctctggg

SEQ ID NO: 949 - DNA, 23 bp, Artificial Sequence
  Synthetic Polynucleotide
actataytgttcatcccctctgg

SEQ ID NO: 950 - DNA, 23 bp, Artificial Sequence
  Synthetic Polynucleotide
cgtggytggggaagggcagctgg

SEQ ID NO: 951 - DNA, 23 bp, Artificial Sequence
  Synthetic Polynucleotide
cgtaataygggaaaaaggcgtgg

SEQ ID NO: 952 - DNA, 23 bp, Artificial Sequence
  Synthetic Polynucleotide
aataygggaaaaaggcgtggtgg

SEQ ID NO: 953 - DNA, 23 bp, Artificial Sequence
  Synthetic Polynucleotide
ataygggaaaaaggcgtggtggg

SEQ ID NO: 954 - DNA, 23 bp, Artificial Sequence
  Synthetic Polynucleotide
cggytgaactctcagtcttctgg

SEQ ID NO: 955 - DNA, 23 bp, Artificial Sequence
  Synthetic Polynucleotide
actgcggyatgggcggggccagg

SEQ ID NO: 956 - DNA, 23 bp, Artificial Sequence
  Synthetic Polynucleotide
ctgcggyatgggcggggccaggg

SEQ ID NO: 957 - DNA, 23 bp, Artificial Sequence
  Synthetic Polynucleotide
cggyatgggcggggccagggtgg

SEQ ID NO: 958 - DNA, 23 bp, Artificial Sequence
  Synthetic Polynucleotide
cggtytgaagcgtgcagagatgg

SEQ ID NO: 959 - DNA, 23 bp, Artificial Sequence
  Synthetic Polynucleotide
cgcyttgaaaaaaaaagaaaggg

SEQ ID NO: 960 - DNA, 23 bp, Artificial Sequence
  Synthetic Polynucleotide
tcgcyttgaaaaaaaaagaaagg

SEQ ID NO: 961 - DNA, 23 bp, Artificial Sequence
  Synthetic Polynucleotide
cgcygaagatgaggcagaccagg

SEQ ID NO: 962 - DNA, 23 bp, Artificial Sequence
  Synthetic Polynucleotide
cgcggytgagggtgtagaagtgg

SEQ ID NO: 963 - DNA, 23 bp, Artificial Sequence
  Synthetic Polynucleotide
cgcaygatccacagcaccaatgg

SEQ ID NO: 964 - DNA, 23 bp, Artificial Sequence
  Synthetic Polynucleotide
cgaygttgaagagggcaggcagg

SEQ ID NO: 965 - DNA, 23 bp, Artificial Sequence
  Synthetic Polynucleotide
agcccgaygttgaagagggcagg

SEQ ID NO: 966 - DNA, 23 bp, Artificial Sequence
  Synthetic Polynucleotide
cgaggyggtggtggtccaagtgg

SEQ ID NO: 967 - DNA, 23 bp, Artificial Sequence
  Synthetic Polynucleotide
cgaggyattgccagcagtgcagg

SEQ ID NO: 968 - DNA, 23 bp, Artificial Sequence
  Synthetic Polynucleotide
cgaaaygtgtatctcctcccagg

SEQ ID NO: 969 - DNA, 23 bp, Artificial Sequence
  Synthetic Polynucleotide
cgaaatgyaagtctagttagagg

SEQ ID NO: 970 - DNA, 23 bp, Artificial Sequence
  Synthetic Polynucleotide
gaaatgyaagtctagttagaggg

SEQ ID NO: 971 - DNA, 23 bp, Artificial Sequence
  Synthetic Polynucleotide
cctgtgygtcccccaggggcagg

SEQ ID NO: 972 - DNA, 23 bp, Artificial Sequence
  Synthetic Polynucleotide
ctgtgygtcccccaggggcaggg

SEQ ID NO: 973 - DNA, 23 bp, Artificial Sequence
  Synthetic Polynucleotide
tgtgygtcccccaggggcagggg

SEQ ID NO: 974 - DNA, 23 bp, Artificial Sequence
  Synthetic Polynucleotide
gtgygtcccccaggggcaggggg

SEQ ID NO: 975 - DNA, 23 bp, Artificial Sequence
  Synthetic Polynucleotide
cctaaaaygttggatgctgaagg

SEQ ID NO: 976 - DNA, 23 bp, Artificial Sequence
  Synthetic Polynucleotide
ccggygaggccctggggcggggg

SEQ ID NO: 977 - DNA, 23 bp, Artificial Sequence
  Synthetic Polynucleotide
tccggygaggccctggggcgggg

SEQ ID NO: 978 - DNA, 23 bp, Artificial Sequence
  Synthetic Polynucleotide
atccggygaggccctggggcggg

SEQ ID NO: 979 - DNA, 23 bp, Artificial Sequence
  Synthetic Polynucleotide
gatccggygaggccctggggcgg

SEQ ID NO: 980 - DNA, 23 bp, Artificial Sequence
  Synthetic Polynucleotide
tgayccagggggtctatgggagg

SEQ ID NO: 981 - DNA, 23 bp, Artificial Sequence
  Synthetic Polynucleotide
cggtgayccagggggtctatggg

SEQ ID NO: 982 - DNA, 23 bp, Artificial Sequence
  Synthetic Polynucleotide
ccggtgayccagggggtctatgg

SEQ ID NO: 983 - DNA, 23 bp, Artificial Sequence
  Synthetic Polynucleotide
cccygaaggtggaggatgcaggg

SEQ ID NO: 984 - DNA, 23 bp, Artificial Sequence
  Synthetic Polynucleotide
gcccygaaggtggaggatgcagg

SEQ ID NO: 985 - DNA, 23 bp, Artificial Sequence
  Synthetic Polynucleotide
ccctygggtgcaggtttgtgagg

SEQ ID NO: 986 - DNA, 23 bp, Artificial Sequence
  Synthetic Polynucleotide
cccaygtacctgccgcgccctgg

SEQ ID NO: 987 - DNA, 23 bp, Artificial Sequence
  Synthetic Polynucleotide
ccaytggtcttgagccaagtggg

SEQ ID NO: 988 - DNA, 23 bp, Artificial Sequence
  Synthetic Polynucleotide
tccaytggtcttgagccaagtgg

SEQ ID NO: 989 - DNA, 23 bp, Artificial Sequence
  Synthetic Polynucleotide
ccaygttgtcaatgtccagctgg

SEQ ID NO: 990 - DNA, 23 bp, Artificial Sequence
  Synthetic Polynucleotide
ccaygtggaccctggtgagctgg

SEQ ID NO: 991 - DNA, 23 bp, Artificial Sequence
  Synthetic Polynucleotide
tgtccaygatggcggcgcggcgg

SEQ ID NO: 992 - DNA, 23 bp, Artificial Sequence
  Synthetic Polynucleotide
ccaygatggcggcgcggcggcgg

SEQ ID NO: 993 - DNA, 23 bp, Artificial Sequence
  Synthetic Polynucleotide
ccayagaagcccacgatgtacgg

SEQ ID NO: 994 - DNA, 23 bp, Artificial Sequence
  Synthetic Polynucleotide
ccaggyatcccgggggtaggtgg

SEQ ID NO: 995 - DNA, 23 bp, Artificial Sequence
  Synthetic Polynucleotide
caggyatcccgggggtaggtggg

SEQ ID NO: 996 - DNA, 23 bp, Artificial Sequence
  Synthetic Polynucleotide
ccagaytgtcagcaaacacctgg

SEQ ID NO: 997 - DNA, 23 bp, Artificial Sequence
  Synthetic Polynucleotide
ccaagygagtacagcgcacctgg

SEQ ID NO: 998 - DNA, 23 bp, Artificial Sequence
  Synthetic Polynucleotide
caagygagtacagcgcacctggg

SEQ ID NO: 999 - DNA, 23 bp, Artificial Sequence
  Synthetic Polynucleotide
aagygagtacagcgcacctgggg

SEQ ID NO: 1000 - DNA, 23 bp, Artificial Sequence
  Synthetic Polynucleotide
agaytaccaccacctggtggagg

SEQ ID NO: 1001 - DNA, 23 bp, Artificial Sequence
  Synthetic Polynucleotide
ccaagaytaccaccacctggtgg

SEQ ID NO: 1002 - DNA, 23 bp, Artificial Sequence
  Synthetic Polynucleotide
catgygagtgcaggcggagcagg

SEQ ID NO: 1003 - DNA, 23 bp, Artificial Sequence
  Synthetic Polynucleotide
cagytgaatttgtgtgtaaacgg

SEQ ID NO: 1004 - DNA, 23 bp, Artificial Sequence
  Synthetic Polynucleotide
cagyggtacagggtgaccacggg

SEQ ID NO: 1005 - DNA, 23 bp, Artificial Sequence
  Synthetic Polynucleotide
ccagyggtacagggtgaccacgg

SEQ ID NO: 1006 - DNA, 23 bp, Artificial Sequence
  Synthetic Polynucleotide
cagyagagcttgcggcgccgggg

SEQ ID NO: 1007 - DNA, 23 bp, Artificial Sequence
  Synthetic Polynucleotide
gcagyagagcttgcggcgccggg

SEQ ID NO: 1008 - DNA, 23 bp, Artificial Sequence
  Synthetic Polynucleotide
cgcagyagagcttgcggcgccgg

SEQ ID NO: 1009 - DNA, 23 bp, Artificial Sequence
  Synthetic Polynucleotide
cagttagygattggcaactttgg

SEQ ID NO: 1010 - DNA, 23 bp, Artificial Sequence
  Synthetic Polynucleotide
cagtggygagactcgcccgcagg

SEQ ID NO: 1011 - DNA, 23 bp, Artificial Sequence
  Synthetic Polynucleotide
agtggygagactcgcccgcaggg

SEQ ID NO: 1012 - DNA, 23 bp, Artificial Sequence
  Synthetic Polynucleotide
caggtggyacacgaagtcctggg

SEQ ID NO: 1013 - DNA, 23 bp, Artificial Sequence
  Synthetic Polynucleotide
cagaggtyctttgacagctttgg

SEQ ID NO: 1014 - DNA, 23 bp, Artificial Sequence
  Synthetic Polynucleotide
agcacytgtgaggaagttcctgg

SEQ ID NO: 1015 - DNA, 23 bp, Artificial Sequence
  Synthetic Polynucleotide
gcacytgtgaggaagttcctggg

SEQ ID NO: 1016 - DNA, 23 bp, Artificial Sequence
  Synthetic Polynucleotide
cacytgtgaggaagttcctgggg

SEQ ID NO: 1017 - DNA, 23 bp, Artificial Sequence
  Synthetic Polynucleotide
cacygagggaaagcactgcaggg

SEQ ID NO: 1018 - DNA, 23 bp, Artificial Sequence
  Synthetic Polynucleotide
gcacygagggaaagcactgcagg

SEQ ID NO: 1019 - DNA, 23 bp, Artificial Sequence
  Synthetic Polynucleotide
cactgytgacgaaggtagcaggg

SEQ ID NO: 1020 - DNA, 23 bp, Artificial Sequence
  Synthetic Polynucleotide
gcactgytgacgaaggtagcagg

SEQ ID NO: 1021 - DNA, 23 bp, Artificial Sequence
  Synthetic Polynucleotide
cactgygagtaagctggaagtgg

SEQ ID NO: 1022 - DNA, 23 bp, Artificial Sequence
  Synthetic Polynucleotide
cactggygtatacacaggtgagg

SEQ ID NO: 1023 - DNA, 23 bp, Artificial Sequence
  Synthetic Polynucleotide
cactggayatggaaatagagagg

SEQ ID NO: 1024 - DNA, 23 bp, Artificial Sequence
  Synthetic Polynucleotide
cactaytggggtctcggtcaagg

SEQ ID NO: 1025 - DNA, 23 bp, Artificial Sequence
  Synthetic Polynucleotide
gcacgygagtggccatcctcagg

SEQ ID NO: 1026 - DNA, 23 bp, Artificial Sequence
  Synthetic Polynucleotide
cacgygagtggccatcctcaggg

SEQ ID NO: 1027 - DNA, 23 bp, Artificial Sequence
  Synthetic Polynucleotide
cacgagtytcttactgagaatgg

SEQ ID NO: 1028 - DNA, 23 bp, Artificial Sequence
  Synthetic Polynucleotide
gagtytcttactgagaatggagg

SEQ ID NO: 1029 - DNA, 23 bp, Artificial Sequence
  Synthetic Polynucleotide
cacaytgacacatgtggccaggg

SEQ ID NO: 1030 - DNA, 23 bp, Artificial Sequence
  Synthetic Polynucleotide
ccacaytgacacatgtggccagg

SEQ ID NO: 1031 - DNA, 23 bp, Artificial Sequence
  Synthetic Polynucleotide
cacataayacgaactggtgctgg

SEQ ID NO: 1032 - DNA, 23 bp, Artificial Sequence
  Synthetic Polynucleotide
cacagygggtccctgtctcctgg

SEQ ID NO: 1033 - DNA, 23 bp, Artificial Sequence
  Synthetic Polynucleotide
acagygggtccctgtctcctggg

SEQ ID NO: 1034 - DNA, 23 bp, Artificial Sequence
  Synthetic Polynucleotide
caaygatgagcttgaagatgagg

SEQ ID NO: 1035 - DNA, 23 bp, Artificial Sequence
  Synthetic Polynucleotide
caaygaagaggaattgcccctgg

SEQ ID NO: 1036 - DNA, 23 bp, Artificial Sequence
  Synthetic Polynucleotide
caagtygttagctgccaacaagg

SEQ ID NO: 1037 - DNA, 23 bp, Artificial Sequence
  Synthetic Polynucleotide
caagaytggggacttcgggctgg

SEQ ID NO: 1038 - DNA, 23 bp, Artificial Sequence
  Synthetic Polynucleotide
caagayggcggctcccagggagg

SEQ ID NO: 1039 - DNA, 23 bp, Artificial Sequence
  Synthetic Polynucleotide
caagaggytggtgatctgcaagg

SEQ ID NO: 1040 - DNA, 23 bp, Artificial Sequence
  Synthetic Polynucleotide
caagaayagtaggtaaggccagg

SEQ ID NO: 1041 - DNA, 23 bp, Artificial Sequence
  Synthetic Polynucleotide
caagaaaygtgctgctgatctgg

SEQ ID NO: 1042 - DNA, 23 bp, Artificial Sequence
  Synthetic Polynucleotide
aagaaaygtgctgctgatctggg

SEQ ID NO: 1043 - DNA, 23 bp, Artificial Sequence
  Synthetic Polynucleotide
caaaatayggaacttgattttgg

SEQ ID NO: 1044 - DNA, 23 bp, Artificial Sequence
  Synthetic Polynucleotide
attgaaayagagtaacaagaagg

SEQ ID NO: 1045 - DNA, 23 bp, Artificial Sequence
  Synthetic Polynucleotide
atgytggaggcttggaactctgg

SEQ ID NO: 1046 - DNA, 23 bp, Artificial Sequence
  Synthetic Polynucleotide
atgtatyaattacagacacttgg

SEQ ID NO: 1047 - DNA, 23 bp, Artificial Sequence
  Synthetic Polynucleotide
atggyaaggagcaagggagcagg

SEQ ID NO: 1048 - DNA, 23 bp, Artificial Sequence
  Synthetic Polynucleotide
atcytagggtaaggtgacttagg

SEQ ID NO: 1049 - DNA, 23 bp, Artificial Sequence
  Synthetic Polynucleotide
atcyaaagcaaaagacaagcagg

SEQ ID NO: 1050 - DNA, 23 bp, Artificial Sequence
  Synthetic Polynucleotide
atcaytggggtggatcccgaagg

SEQ ID NO: 1051 - DNA, 23 bp, Artificial Sequence
  Synthetic Polynucleotide
tcaytggggtggatcccgaaggg

SEQ ID NO: 1052 - DNA, 23 bp, Artificial Sequence
  Synthetic Polynucleotide
atcatytggaacagtctacaagg

SEQ ID NO: 1053 - DNA, 23 bp, Artificial Sequence
  Synthetic Polynucleotide
tcatytggaacagtctacaaggg

SEQ ID NO: 1054 - DNA, 23 bp, Artificial Sequence
  Synthetic Polynucleotide
atcattgygagtgtattataagg

SEQ ID NO: 1055 - DNA, 23 bp, Artificial Sequence
  Synthetic Polynucleotide
tcattgygagtgtattataaggg

SEQ ID NO: 1056 - DNA, 23 bp, Artificial Sequence
  Synthetic Polynucleotide
cattgygagtgtattataagggg

SEQ ID NO: 1057 - DNA, 23 bp, Artificial Sequence
  Synthetic Polynucleotide
atcatggyaagcaagaaacaagg

SEQ ID NO: 1058 - DNA, 23 bp, Artificial Sequence
  Synthetic Polynucleotide
atayagttttcagggcccggagg

SEQ ID NO: 1059 - DNA, 23 bp, Artificial Sequence
  Synthetic Polynucleotide
ctgatayagttttcagggcccgg

SEQ ID NO: 1060 - DNA, 23 bp, Artificial Sequence
  Synthetic Polynucleotide
atatagaygcctctgctcccagg

SEQ ID NO: 1061 - DNA, 23 bp, Artificial Sequence
  Synthetic Polynucleotide
atagtgtycctaaaaggcacggg

SEQ ID NO: 1062 - DNA, 23 bp, Artificial Sequence
  Synthetic Polynucleotide
atagatgycagcacgtttgaagg

SEQ ID NO: 1063 - DNA, 23 bp, Artificial Sequence
  Synthetic Polynucleotide
agtaygtgaagctccagctgtgg

SEQ ID NO: 1064 - DNA, 23 bp, Artificial Sequence
  Synthetic Polynucleotide
cttcaggygagggctggggtggg

SEQ ID NO: 1065 - DNA, 23 bp, Artificial Sequence
  Synthetic Polynucleotide
aggygagggctggggtgggcagg

SEQ ID NO: 1066 - DNA, 23 bp, Artificial Sequence
  Synthetic Polynucleotide
aggtgagyaatctgtcagcaggg

SEQ ID NO: 1067 - DNA, 23 bp, Artificial Sequence
  Synthetic Polynucleotide
agggytggagtaggggccatcgg

SEQ ID NO: 1068 - DNA, 23 bp, Artificial Sequence
  Synthetic Polynucleotide
agggaytgcctacaaacaccagg

SEQ ID NO: 1069 - DNA, 23 bp, Artificial Sequence
  Synthetic Polynucleotide
agcygtgggacaagagcagccgg

SEQ ID NO: 1070 - DNA, 23 bp, Artificial Sequence
  Synthetic Polynucleotide
agcyggtattccctctcgagtgg

SEQ ID NO: 1071 - DNA, 23 bp, Artificial Sequence
  Synthetic Polynucleotide
agcygggtgcccagtacccttgg

SEQ ID NO: 1072 - DNA, 23 bp, Artificial Sequence
  Synthetic Polynucleotide
gagcyggggactggacaatttgg

SEQ ID NO: 1073 - DNA, 23 bp, Artificial Sequence
  Synthetic Polynucleotide
agcyggggactggacaatttggg

SEQ ID NO: 1074 - DNA, 23 bp, Artificial Sequence
  Synthetic Polynucleotide
agcyaggtggcgacctgctccgg

SEQ ID NO: 1075 - DNA, 23 bp, Artificial Sequence
  Synthetic Polynucleotide
agcttytttgtagacaggcatgg

SEQ ID NO: 1076 - DNA, 23 bp, Artificial Sequence
  Synthetic Polynucleotide
agctgtgygatgaagcaggcagg

SEQ ID NO: 1077 - DNA, 23 bp, Artificial Sequence
  Synthetic Polynucleotide
gctggaycgaggccttaaaaggg

SEQ ID NO: 1078 - DNA, 23 bp, Artificial Sequence
  Synthetic Polynucleotide
agctggaycgaggccttaaaagg

SEQ ID NO: 1079 - DNA, 23 bp, Artificial Sequence
  Synthetic Polynucleotide
agctayggccgcagtgattctgg

SEQ ID NO: 1080 - DNA, 23 bp, Artificial Sequence
  Synthetic Polynucleotide
attgycttcccattcccaggtgg

SEQ ID NO: 1081 - DNA, 23 bp, Artificial Sequence
  Synthetic Polynucleotide
agcattgycttcccattcccagg

SEQ ID NO: 1082 - DNA, 23 bp, Artificial Sequence
  Synthetic Polynucleotide
cagcaagbacgtgggcctctggg

SEQ ID NO: 1083 - DNA, 23 bp, Artificial Sequence
  Synthetic Polynucleotide
agcaagbacgtgggcctctgggg

SEQ ID NO: 1084 - DNA, 23 bp, Artificial Sequence
  Synthetic Polynucleotide
gcaagbacgtgggcctctggggg

SEQ ID NO: 1085 - DNA, 23 bp, Artificial Sequence
  Synthetic Polynucleotide
agaytgtggatccgctggcccgg

SEQ ID NO: 1086 - DNA, 23 bp, Artificial Sequence
  Synthetic Polynucleotide
agaytggtgtgcgcaacatccgg

SEQ ID NO: 1087 - DNA, 23 bp, Artificial Sequence
  Synthetic Polynucleotide
agaygagggtctcagccctgcgg

SEQ ID NO: 1088 - DNA, 23 bp, Artificial Sequence
  Synthetic Polynucleotide
agatayggcttctaaaccgaagg

SEQ ID NO: 1089 - DNA, 23 bp, Artificial Sequence
  Synthetic Polynucleotide
agaggytgtgtttacggtagcgg

SEQ ID NO: 1090 - DNA, 23 bp, Artificial Sequence
  Synthetic Polynucleotide
agaagaygctgtttaatctgagg

SEQ ID NO: 1091 - DNA, 23 bp, Artificial Sequence
  Synthetic Polynucleotide
actytttgggatcgacttcctgg

SEQ ID NO: 1092 - DNA, 23 bp, Artificial Sequence
  Synthetic Polynucleotide
actytgatagagtaaataatagg

SEQ ID NO: 1093 - DNA, 23 bp, Artificial Sequence
  Synthetic Polynucleotide
acttytatagtattgaataaagg

SEQ ID NO: 1094 - DNA, 23 bp, Artificial Sequence
  Synthetic Polynucleotide
cttytatagtattgaataaaggg

SEQ ID NO: 1095 - DNA, 23 bp, Artificial Sequence
  Synthetic Polynucleotide
acttygatagagtaaataatagg

SEQ ID NO: 1096 - DNA, 23 bp, Artificial Sequence
  Synthetic Polynucleotide
acttyatttgactactttaatgg

SEQ ID NO: 1097 - DNA, 23 bp, Artificial Sequence
  Synthetic Polynucleotide
cttyattcaaagaccaggaaggg

SEQ ID NO: 1098 - DNA, 23 bp, Artificial Sequence
  Synthetic Polynucleotide
acttyattcaaagaccaggaagg

SEQ ID NO: 1099 - DNA, 23 bp, Artificial Sequence
  Synthetic Polynucleotide
acttttayagtattgaataaagg

SEQ ID NO: 1100 - DNA, 23 bp, Artificial Sequence
  Synthetic Polynucleotide
cttttayagtattgaataaaggg

SEQ ID NO: 1101 - DNA, 23 bp, Artificial Sequence
  Synthetic Polynucleotide
acttayagcttcttgtctccagg

SEQ ID NO: 1102 - DNA, 23 bp, Artificial Sequence
  Synthetic Polynucleotide
actgataycaggtgagagccagg

SEQ ID NO: 1103 - DNA, 23 bp, Artificial Sequence
  Synthetic Polynucleotide
ctgataycaggtgagagccaggg

SEQ ID NO: 1104 - DNA, 23 bp, Artificial Sequence
  Synthetic Polynucleotide
acgytgagctggggctgcgcggg

SEQ ID NO: 1105 - DNA, 23 bp, Artificial Sequence
  Synthetic Polynucleotide
cacgytgagctggggctgcgcgg

SEQ ID NO: 1106 - DNA, 23 bp, Artificial Sequence
  Synthetic Polynucleotide
accytatgatccgcccgccttgg

SEQ ID NO: 1107 - DNA, 23 bp, Artificial Sequence
  Synthetic Polynucleotide
accygtgaagggaacagagatgg

SEQ ID NO: 1108 - DNA, 23 bp, Artificial Sequence
  Synthetic Polynucleotide
ttcaccygtatctgtatggcagg

SEQ ID NO: 1109 - DNA, 23 bp, Artificial Sequence
  Synthetic Polynucleotide
accygtatctgtatggcaggtgg

SEQ ID NO: 1110 - DNA, 23 bp, Artificial Sequence
  Synthetic Polynucleotide
accygagatgcaaaatagggagg

SEQ ID NO: 1111 - DNA, 23 bp, Artificial Sequence
  Synthetic Polynucleotide
gtgaccygagatgcaaaataggg

SEQ ID NO: 1112 - DNA, 23 bp, Artificial Sequence
  Synthetic Polynucleotide
ggtgaccygagatgcaaaatagg

SEQ ID NO: 1113 - DNA, 23 bp, Artificial Sequence
  Synthetic Polynucleotide
accygagagggagggcagccagg

SEQ ID NO: 1114 - DNA, 23 bp, Artificial Sequence
  Synthetic Polynucleotide
acctgygggtgcgtggctgcagg

SEQ ID NO: 1115 - DNA, 23 bp, Artificial Sequence
  Synthetic Polynucleotide
cctgygggtgcgtggctgcaggg

SEQ ID NO: 1116 - DNA, 23 bp, Artificial Sequence
  Synthetic Polynucleotide
accgtygtggcccagcaggacgg

SEQ ID NO: 1117 - DNA, 23 bp, Artificial Sequence
  Synthetic Polynucleotide
acayatttcttaggtttgagggg

SEQ ID NO: 1118 - DNA, 23 bp, Artificial Sequence
  Synthetic Polynucleotide
gacayatttcttaggtttgaggg

SEQ ID NO: 1119 - DNA, 23 bp, Artificial Sequence
  Synthetic Polynucleotide
agacayatttcttaggtttgagg

SEQ ID NO: 1120 - DNA, 23 bp, Artificial Sequence
  Synthetic Polynucleotide
acayatatccctctggacattgg

SEQ ID NO: 1121 - DNA, 23 bp, Artificial Sequence
  Synthetic Polynucleotide
acayagtacaggattcctgcggg

SEQ ID NO: 1122 - DNA, 23 bp, Artificial Sequence
  Synthetic Polynucleotide
gacayagtacaggattcctgcgg

SEQ ID NO: 1123 - DNA, 23 bp, Artificial Sequence
  Synthetic Polynucleotide
acayaggtgcgacggccccaggg

SEQ ID NO: 1124 - DNA, 23 bp, Artificial Sequence
  Synthetic Polynucleotide
gacayaggtgcgacggccccagg

SEQ ID NO: 1125 - DNA, 23 bp, Artificial Sequence
  Synthetic Polynucleotide
acattygggcttttggtaagtgg

SEQ ID NO: 1126 - DNA, 23 bp, Artificial Sequence
  Synthetic Polynucleotide
acatgyagcaggcgcagtagggg

SEQ ID NO: 1127 - DNA, 23 bp, Artificial Sequence
  Synthetic Polynucleotide
gacatgyagcaggcgcagtaggg

SEQ ID NO: 1128 - DNA, 23 bp, Artificial Sequence
  Synthetic Polynucleotide
agacatgyagcaggcgcagtagg

SEQ ID NO: 1129 - DNA, 23 bp, Artificial Sequence
  Synthetic Polynucleotide
acatayatccctctggacattgg

SEQ ID NO: 1130 - DNA, 23 bp, Artificial Sequence
  Synthetic Polynucleotide
acagtyttaggacatcattgtgg

SEQ ID NO: 1131 - DNA, 23 bp, Artificial Sequence
  Synthetic Polynucleotide
acagttayaggttctggtcctgg

SEQ ID NO: 1132 - DNA, 23 bp, Artificial Sequence
  Synthetic Polynucleotide
gttayaggttctggtcctggagg

SEQ ID NO: 1133 - DNA, 23 bp, Artificial Sequence
  Synthetic Polynucleotide
acaaggygagcgtgggctgctgg

SEQ ID NO: 1134 - DNA, 23 bp, Artificial Sequence
  Synthetic Polynucleotide
caaggygagcgtgggctgctggg

SEQ ID NO: 1135 - DNA, 23 bp, Artificial Sequence
  Synthetic Polynucleotide
acaagatygtctacagaaacagg

SEQ ID NO: 1136 - DNA, 23 bp, Artificial Sequence
  Synthetic Polynucleotide
aatyttggaggcagaagctctgg

SEQ ID NO: 1137 - DNA, 23 bp, Artificial Sequence
  Synthetic Polynucleotide
aattygttttcttacaaaatcgg

SEQ ID NO: 1138 - DNA, 23 bp, Artificial Sequence
  Synthetic Polynucleotide
aatgtyggcaccatcctgggagg

SEQ ID NO: 1139 - DNA, 23 bp, Artificial Sequence
  Synthetic Polynucleotide
aatggatyctgaatgtacagagg

SEQ ID NO: 1140 - DNA, 23 bp, Artificial Sequence
  Synthetic Polynucleotide
aataaagyagaatatcgtcaagg

SEQ ID NO: 1141 - DNA, 23 bp, Artificial Sequence
  Synthetic Polynucleotide
aagygtgtgcctgtgtgccgagg

SEQ ID NO: 1142 - DNA, 23 bp, Artificial Sequence
  Synthetic Polynucleotide
aagygattgcagcagtgaaatgg

SEQ ID NO: 1143 - DNA, 23 bp, Artificial Sequence
  Synthetic Polynucleotide
aagyagattttctgccaggtggg

SEQ ID NO: 1144 - DNA, 23 bp, Artificial Sequence
  Synthetic Polynucleotide
gaagyagattttctgccaggtgg

SEQ ID NO: 1145 - DNA, 23 bp, Artificial Sequence
  Synthetic Polynucleotide
gtagaagyagattttctgccagg

SEQ ID NO: 1146 - DNA, 23 bp, Artificial Sequence
  Synthetic Polynucleotide
aagtytgatgcagaccagaaagg

SEQ ID NO: 1147 - DNA, 23 bp, Artificial Sequence
  Synthetic Polynucleotide
aaggaaygtgttttacccggagg

SEQ ID NO: 1148 - DNA, 23 bp, Artificial Sequence
  Synthetic Polynucleotide
aagayggtgacagaaaaggcagg

SEQ ID NO: 1149 - DNA, 23 bp, Artificial Sequence
  Synthetic Polynucleotide
aagaayatgcccaaaacatctgg

SEQ ID NO: 1150 - DNA, 23 bp, Artificial Sequence
  Synthetic Polynucleotide
aagaaaayctacgccatgggtgg

SEQ ID NO: 1151 - DNA, 23 bp, Artificial Sequence
  Synthetic Polynucleotide
aaaayctacgccatgggtggagg

SEQ ID NO: 1152 - DNA, 23 bp, Artificial Sequence
  Synthetic Polynucleotide
aacyagagtaatagcgggtcagg

SEQ ID NO: 1153 - DNA, 23 bp, Artificial Sequence
  Synthetic Polynucleotide
aactyggtcctgcgggatggggg

SEQ ID NO: 1154 - DNA, 23 bp, Artificial Sequence
  Synthetic Polynucleotide
gaactyggtcctgcgggatgggg

SEQ ID NO: 1155 - DNA, 23 bp, Artificial Sequence
  Synthetic Polynucleotide
ggaactyggtcctgcgggatggg

SEQ ID NO: 1156 - DNA, 23 bp, Artificial Sequence
  Synthetic Polynucleotide
aggaactyggtcctgcgggatgg

SEQ ID NO: 1157 - DNA, 23 bp, Artificial Sequence
  Synthetic Polynucleotide
aacagayaatgtcagacaagagg

SEQ ID NO: 1158 - DNA, 23 bp, Artificial Sequence
  Synthetic Polynucleotide
aacaayggtggaacctgagaagg

SEQ ID NO: 1159 - DNA, 23 bp, Artificial Sequence
  Synthetic Polynucleotide
aaatgyttcctgtacacctgtgg

SEQ ID NO: 1160 - DNA, 23 bp, Artificial Sequence
  Synthetic Polynucleotide
aaatatgyggtcacactttgtgg

SEQ ID NO: 1161 - DNA, 23 bp, Artificial Sequence
  Synthetic Polynucleotide
aaaggygggcctgggacctgagg

SEQ ID NO: 1162 - DNA, 23 bp, Artificial Sequence
  Synthetic Polynucleotide
aaaaygtgttggtgcttgagggg

SEQ ID NO: 1163 - DNA, 23 bp, Artificial Sequence
  Synthetic Polynucleotide
gaaaaygtgttggtgcttgaggg

SEQ ID NO: 1164 - DNA, 23 bp, Artificial Sequence
  Synthetic Polynucleotide
agaaaaygtgttggtgcttgagg

SEQ ID NO: 1165 - DNA, 23 bp, Artificial Sequence
  Synthetic Polynucleotide
aaaattygcaagtatgtcttagg

SEQ ID NO: 1166 - DNA, 23 bp, Artificial Sequence
  Synthetic Polynucleotide
aaattygcaagtatgtcttaggg

SEQ ID NO: 1167 - DNA, 23 bp, Artificial Sequence
  Synthetic Polynucleotide
tggttcyaatggatgtctgctgg

SEQ ID NO: 1168 - DNA, 23 bp, Artificial Sequence
  Synthetic Polynucleotide
ggttcyaatggatgtctgctggg

SEQ ID NO: 1169 - DNA, 23 bp, Artificial Sequence
  Synthetic Polynucleotide
tggctgycagggacccagcaagg

SEQ ID NO: 1170 - DNA, 23 bp, Artificial Sequence
  Synthetic Polynucleotide
ctgycagggacccagcaaggagg

SEQ ID NO: 1171 - DNA, 23 bp, Artificial Sequence
  Synthetic Polynucleotide
agttccygacggctgaggagcgg

SEQ ID NO: 1172 - DNA, 23 bp, Artificial Sequence
  Synthetic Polynucleotide
ccagyacggggaggtgtacgagg

SEQ ID NO: 1173 - DNA, 23 bp, Artificial Sequence
  Synthetic Polynucleotide
cagyacggggaggtgtacgaggg

SEQ ID NO: 1174 - DNA, 23 bp, Artificial Sequence
  Synthetic Polynucleotide
agggcygtcggaccttcgagtgg

SEQ ID NO: 1175 - DNA, 23 bp, Artificial Sequence
  Synthetic Polynucleotide
gggcygtcggaccttcgagtggg

SEQ ID NO: 1176 - DNA, 23 bp, Artificial Sequence
  Synthetic Polynucleotide
ggcygtcggaccttcgagtgggg

SEQ ID NO: 1177 - DNA, 23 bp, Artificial Sequence
  Synthetic Polynucleotide
attcccygatgaggcagatgcgg

SEQ ID NO: 1178 - DNA, 23 bp, Artificial Sequence
  Synthetic Polynucleotide
ttcccygatgaggcagatgcggg

SEQ ID NO: 1179 - DNA, 23 bp, Artificial Sequence
  Synthetic Polynucleotide
ataccyggcaagcaatagcgcgg

SEQ ID NO: 1180 - DNA, 23 bp, Artificial Sequence
  Synthetic Polynucleotide
gtaaytgcaagatctacaaaagg

SEQ ID NO: 1181 - DNA, 23 bp, Artificial Sequence
  Synthetic Polynucleotide
acatygacaaccatcggctatgg

SEQ ID NO: 1182 - DNA, 23 bp, Artificial Sequence
  Synthetic Polynucleotide
gaccygctgccgtcagcgcctgg

SEQ ID NO: 1183 - DNA, 23 bp, Artificial Sequence
  Synthetic Polynucleotide
tcccacyggacaactgcctctgg

SEQ ID NO: 1184 - DNA, 23 bp, Artificial Sequence
  Synthetic Polynucleotide
gtagayaccttagagaacaatgg

SEQ ID NO: 1185 - DNA, 23 bp, Artificial Sequence
  Synthetic Polynucleotide
tgccaytgctgtggacaacctgg

SEQ ID NO: 1186 - DNA, 23 bp, Artificial Sequence
  Synthetic Polynucleotide
gtcgcygcccgtggcccctgcgg

SEQ ID NO: 1187 - DNA, 23 bp, Artificial Sequence
  Synthetic Polynucleotide
attggyacgtgatccatcctagg

SEQ ID NO: 1188 - DNA, 23 bp, Artificial Sequence
  Synthetic Polynucleotide
gacggcyctgtaggctttggagg

SEQ ID NO: 1189 - DNA, 23 bp, Artificial Sequence
  Synthetic Polynucleotide
cggccaygcagtcctgtgccagg

SEQ ID NO: 1190 - DNA, 23 bp, Artificial Sequence
  Synthetic Polynucleotide
ggccaygcagtcctgtgccaggg

SEQ ID NO: 1191 - DNA, 23 bp, Artificial Sequence
  Synthetic Polynucleotide
ctgcyggtctaccagggcaaagg

SEQ ID NO: 1192 - DNA, 23 bp, Artificial Sequence
  Synthetic Polynucleotide
tgatytcttgggagaagaactgg

SEQ ID NO: 1193 - DNA, 23 bp, Artificial Sequence
  Synthetic Polynucleotide
gcccygcacgcaaatgtgagtgg

SEQ ID NO: 1194 - DNA, 23 bp, Artificial Sequence
  Synthetic Polynucleotide
cccygcacgcaaatgtgagtggg

SEQ ID NO: 1195 - DNA, 23 bp, Artificial Sequence
  Synthetic Polynucleotide
ttgtgcyaggaagttatgacagg

SEQ ID NO: 1196 - DNA, 23 bp, Artificial Sequence
  Synthetic Polynucleotide
gcgttyacgtgtcccccctttgg

SEQ ID NO: 1197 - DNA, 23 bp, Artificial Sequence
  Synthetic Polynucleotide
cgttyacgtgtcccccctttggg

SEQ ID NO: 1198 - DNA, 23 bp, Artificial Sequence
  Synthetic Polynucleotide
acgctytcaaggtggctgcccgg

SEQ ID NO: 1199 - DNA, 23 bp, Artificial Sequence
  Synthetic Polynucleotide
cgctytcaaggtggctgcccggg

SEQ ID NO: 1200 - DNA, 23 bp, Artificial Sequence
  Synthetic Polynucleotide
acttycccttattccatccacgg

SEQ ID NO: 1201 - DNA, 23 bp, Artificial Sequence
  Synthetic Polynucleotide
cttycccttattccatccacggg

SEQ ID NO: 1202 - DNA, 23 bp, Artificial Sequence
  Synthetic Polynucleotide
catgyttctgctgatcgtgctgg

SEQ ID NO: 1203 - DNA, 23 bp, Artificial Sequence
  Synthetic Polynucleotide
atgyttctgctgatcgtgctggg

SEQ ID NO: 1204 - DNA, 23 bp, Artificial Sequence
  Synthetic Polynucleotide
aggccyggagccctgtttttagg

SEQ ID NO: 1205 - DNA, 23 bp, Artificial Sequence
  Synthetic Polynucleotide
gcagcycttcttagggggtgtgg

SEQ ID NO: 1206 - DNA, 23 bp, Artificial Sequence
  Synthetic Polynucleotide
accatccyggagggccgcctggg

SEQ ID NO: 1207 - DNA, 23 bp, Artificial Sequence
  Synthetic Polynucleotide
ctacycaactgctggagggaagg

SEQ ID NO: 1208 - DNA, 23 bp, Artificial Sequence
  Synthetic Polynucleotide
gcctccyggcgctacggaagtgg

SEQ ID NO: 1209 - DNA, 23 bp, Artificial Sequence
  Synthetic Polynucleotide
cctccyggcgctacggaagtggg

SEQ ID NO: 1210 - DNA, 23 bp, Artificial Sequence
  Synthetic Polynucleotide
ctccyggcgctacggaagtgggg

SEQ ID NO: 1211 - DNA, 23 bp, Artificial Sequence
  Synthetic Polynucleotide
tagagytctgcttgaaacatagg

SEQ ID NO: 1212 - DNA, 23 bp, Artificial Sequence
  Synthetic Polynucleotide
catcgcgyccaacaaccgtaagg

SEQ ID NO: 1213 - DNA, 23 bp, Artificial Sequence
  Synthetic Polynucleotide
atcgcgyccaacaaccgtaaggg

SEQ ID NO: 1214 - DNA, 23 bp, Artificial Sequence
  Synthetic Polynucleotide
agctctycctcatcatggcctgg

SEQ ID NO: 1215 - DNA, 23 bp, Artificial Sequence
  Synthetic Polynucleotide
tgtgtgcyggcccatcactttgg

SEQ ID NO: 1216 - DNA, 23 bp, Artificial Sequence
  Synthetic Polynucleotide
tccycggtggctcaccacattgg

SEQ ID NO: 1217 - DNA, 23 bp, Artificial Sequence
  Synthetic Polynucleotide
ttccyggtcatgcactacagagg

SEQ ID NO: 1218 - DNA, 23 bp, Artificial Sequence
  Synthetic Polynucleotide
aatayggcggccgaggcggacgg

SEQ ID NO: 1219 - DNA, 23 bp, Artificial Sequence
  Synthetic Polynucleotide
tagcaayggatcgtgggcaatgg

SEQ ID NO: 1220 - DNA, 23 bp, Artificial Sequence
  Synthetic Polynucleotide
acctyaactctgggacctgctgg

SEQ ID NO: 1221 - DNA, 23 bp, Artificial Sequence
  Synthetic Polynucleotide
gccctgcygtacccgctgcccgg

SEQ ID NO: 1222 - DNA, 23 bp, Artificial Sequence
  Synthetic Polynucleotide
tgcygtacccgctgcccggctgg

SEQ ID NO: 1223 - DNA, 23 bp, Artificial Sequence
  Synthetic Polynucleotide
atgycatcagcgtggtgttccgg

SEQ ID NO: 1224 - DNA, 23 bp, Artificial Sequence
  Synthetic Polynucleotide
cagctacygggatgcccccctgg

SEQ ID NO: 1225 - DNA, 23 bp, Artificial Sequence
  Synthetic Polynucleotide
agctacygggatgcccccctggg

SEQ ID NO: 1226 - DNA, 23 bp, Artificial Sequence
  Synthetic Polynucleotide
tgagcyggtgggcccaatgcagg

SEQ ID NO: 1227 - DNA, 23 bp, Artificial Sequence
  Synthetic Polynucleotide
ttacttcyctttggctatgaagg

SEQ ID NO: 1228 - DNA, 23 bp, Artificial Sequence
  Synthetic Polynucleotide
tgcygtaccaagtgccacaaagg

SEQ ID NO: 1229 - DNA, 23 bp, Artificial Sequence
  Synthetic Polynucleotide
ctccayactgagctgtgccacgg

SEQ ID NO: 1230 - DNA, 23 bp, Artificial Sequence
  Synthetic Polynucleotide
ggggygcttcaaggccattgtgg

SEQ ID NO: 1231 - DNA, 23 bp, Artificial Sequence
  Synthetic Polynucleotide
aagctccyggacttttttctggg

SEQ ID NO: 1232 - DNA, 23 bp, Artificial Sequence
  Synthetic Polynucleotide
aaayccaccccttacgagtgcgg

SEQ ID NO: 1233 - DNA, 23 bp, Artificial Sequence
  Synthetic Polynucleotide
ttccggygagtgggccacactgg

SEQ ID NO: 1234 - DNA, 23 bp, Artificial Sequence
  Synthetic Polynucleotide
cacctyctttgcccatcagcagg

SEQ ID NO: 1235 - DNA, 23 bp, Artificial Sequence
  Synthetic Polynucleotide
tcaccgcytcaatgacacagagg

SEQ ID NO: 1236 - DNA, 23 bp, Artificial Sequence
  Synthetic Polynucleotide
ctayccgccatcccatacattgg

SEQ ID NO: 1237 - DNA, 23 bp, Artificial Sequence
  Synthetic Polynucleotide
ttcacccyggtccctgtctgggg

SEQ ID NO: 1238 - DNA, 23 bp, Artificial Sequence
  Synthetic Polynucleotide
gaggccayggagctgctgcaggg

SEQ ID NO: 1239 - DNA, 23 bp, Artificial Sequence
  Synthetic Polynucleotide
ctcactcyaaaaaactttaccgg

SEQ ID NO: 1240 - DNA, 23 bp, Artificial Sequence
  Synthetic Polynucleotide
ggtccyggatgtggtgaggaagg

SEQ ID NO: 1241 - DNA, 23 bp, Artificial Sequence
  Synthetic Polynucleotide
cggcytcaaccccacagcaatgg

SEQ ID NO: 1242 - DNA, 23 bp, Artificial Sequence
  Synthetic Polynucleotide
ggcytcaaccccacagcaatggg

SEQ ID NO: 1243 - DNA, 23 bp, Artificial Sequence
  Synthetic Polynucleotide
gccatccygggtatggggtgggg

SEQ ID NO: 1244 - DNA, 23 bp, Artificial Sequence
  Synthetic Polynucleotide
ccatccygggtatggggtggggg

SEQ ID NO: 1245 - DNA, 23 bp, Artificial Sequence
  Synthetic Polynucleotide
catccygggtatggggtgggggg

SEQ ID NO: 1246 - DNA, 23 bp, Artificial Sequence
  Synthetic Polynucleotide
ggtctytgacgtcttcctggtgg

SEQ ID NO: 1247 - DNA, 23 bp, Artificial Sequence
  Synthetic Polynucleotide
cgcyggccaccagcactgccagg

SEQ ID NO: 1248 - DNA, 23 bp, Artificial Sequence
  Synthetic Polynucleotide
gagygccgcctggaggtgcgagg

SEQ ID NO: 1249 - DNA, 23 bp, Artificial Sequence
  Synthetic Polynucleotide
aatccygtactatgtctacatgg

SEQ ID NO: 1250 - DNA, 23 bp, Artificial Sequence
  Synthetic Polynucleotide
atccygtactatgtctacatggg

SEQ ID NO: 1251 - DNA, 23 bp, Artificial Sequence
  Synthetic Polynucleotide
tccygtactatgtctacatgggg

SEQ ID NO: 1252 - DNA, 23 bp, Artificial Sequence
  Synthetic Polynucleotide
ataytttctggtccattgaaagg

SEQ ID NO: 1253 - DNA, 23 bp, Artificial Sequence
  Synthetic Polynucleotide
catctytgactgtgtctacacgg

SEQ ID NO: 1254 - DNA, 23 bp, Artificial Sequence
  Synthetic Polynucleotide
aggtgcygttctggggcctacgg

SEQ ID NO: 1255 - DNA, 23 bp, Artificial Sequence
  Synthetic Polynucleotide
ggtgcygttctggggcctacggg

SEQ ID NO: 1256 - DNA, 23 bp, Artificial Sequence
  Synthetic Polynucleotide
ggacaaygtagaaatactcctgg

SEQ ID NO: 1257 - DNA, 23 bp, Artificial Sequence
  Synthetic Polynucleotide
cttaytacagttaccagaacagg

SEQ ID NO: 1258 - DNA, 23 bp, Artificial Sequence
  Synthetic Polynucleotide
agcttcayggcgcccgcgccggg

SEQ ID NO: 1259 - DNA, 23 bp, Artificial Sequence
  Synthetic Polynucleotide
tcayggcgcccgcgccgggccgg

SEQ ID NO: 1260 - DNA, 23 bp, Artificial Sequence
  Synthetic Polynucleotide
atctctcytggggctccctgggg

(The sequence listing continues in the following parts.)

What is claimed is:

1. A fusion protein comprising:
   (i) a Cas9 domain, wherein the Cas9 domain when in conjunction with a bound guide RNA (gRNA) specifically binds to a target nucleic acid sequence;
   (ii) a cytidine deaminase domain, wherein the cytidine deaminase domain deaminates a cytosine base in a single-stranded portion of the target nucleic acid sequence when in conjunction with the Cas9 domain and the gRNA; and
   (iii) an uracil glycosylase inhibitor (UGI) domain, wherein the UGI domain inhibits a uracil-DNA glycosylase.

2. The fusion protein of claim 1, wherein the Cas9 domain comprises the amino acid sequence provided in SEQ ID NO: 674.

3. The fusion protein of claim 1, wherein the Cas9 domain is a Cas9 nickase (nCas9) domain that cuts a nucleotide target strand of a nucleotide duplex, wherein the nucleotide target strand is the strand that binds to the gRNA.

4. The fusion protein of claim 1, wherein the Cas9 domain is a Cas9 nickase (nCas9) domain that comprises a D10A mutation in the amino acid sequence provided in SEQ ID NO: 10, or a corresponding mutation in any of the amino acid sequences provided in SEQ ID NOs: 11-260.

5. The fusion protein of claim 1, wherein the Cas9 domain is a Cas9 nickase (nCas9) domain that comprises one or more of N497A, R661A, Q695A, or Q926A mutations in the amino acid sequence provided in SEQ ID NO: 10, or one or more corresponding mutations in any of the amino acid sequences provided in SEQ ID NOs: 11-260.

6. The fusion protein of claim 1, wherein the cytidine deaminase domain is a deaminase from an apolipoprotein B mRNA-editing complex (APOBEC) family deaminase.

7. The fusion protein of claim 6, wherein the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

8. The fusion protein of claim 1, wherein the cytidine deaminase domain comprises an amino acid sequence selected from the group consisting of SEQ ID NOs: 266-284, 607-610, 5724-5736, and 5738-5741.

9. The fusion protein of claim 1, wherein the cytidine deaminase domain is a rat APOBEC1 (rAPOBEC1) deaminase comprising one or more mutations selected from the group consisting of W90Y, R126E, and R132E in SEQ ID NO: 284, or one or more corresponding mutations in another APOBEC deaminase.

10. The fusion protein of claim 1, wherein the cytidine deaminase domain is a human APOBEC1 (hAPOBEC1) deaminase comprising one or more mutations selected from the group consisting of W90Y, Q126E, and R132E in SEQ ID NO: 5724, or one or more corresponding mutations in another APOBEC deaminase.

11. The fusion protein of claim 1, wherein the cytidine deaminase domain is a human APOBEC3G (hAPOBEC3G) deaminase comprising one or more mutations selected from the group consisting of W285Y, R320E, and R326E in SEQ ID NO: 275, or one or more corresponding mutations in another APOBEC deaminase.

12. The fusion protein of claim 1, wherein the cytidine deaminase domain is an activation-induced deaminase (AID).

13. The fusion protein of claim 1, wherein the cytidine deaminase domain is a cytidine deaminase 1 from *Petromyzon marinus* (pmCDA1).

14. The fusion protein of claim 1, wherein the UGI domain comprises the amino acid sequence as set forth in SEQ ID NO: 600.

15. The fusion protein of claim 1, wherein the fusion protein comprises the structure:
   $NH_2$-[cytidine deaminase domain]-[Cas9 domain]-[UGI domain]-COOH, and wherein each instance of "-" comprises an optional linker.

16. The fusion protein of claim 1, wherein the cytidine deaminase domain of (ii) and the Cas9 domain of (i) are linked via a linker comprising the amino acid sequence $(GGGS)_n$ (SEQ ID NO: 265)$_n$, $(GGGGS)_n$ (SEQ ID NO: 5)$_n$, $(G)_n$, $(EAAAK)_n$ (SEQ ID NO: 6)$_n$, $(GGS)_n$, $(SGGS)_n$ (SEQ ID NO: 4288)$_n$, SGSETPGTSESATPES (SEQ ID NO: 7)$_n$, or $(XP)_n$ motif, or a combination thereof, wherein n is independently an integer between 1 and 30, inclusive, and wherein X is any amino acid.

17. The fusion protein of claim 1, wherein the cytidine deaminase domain of (ii) and the Cas9 domain of (i) are linked via a linker comprising the amino acid sequence: SGSETPGTSESATPES (SEQ ID NO: 7).

18. The fusion protein of claim 1 further comprising a nuclear localization sequence (NLS).

19. The fusion protein of claim 18, wherein the NLS comprises the amino acid sequence PKKKRKV (SEQ ID NO: 741) or MDSLLMNRRKFLYQFKNVRWAKGRRETYLC (SEQ ID NO: 742).

20. The fusion protein of claim 18, wherein the fusion protein comprises the structure: $NH_2$-[cytidine deaminase domain]-[Cas9 domain]-[UGI domain]-[NLS]-COOH, and wherein each instance of "-" comprises an optional linker.

21. The fusion protein of claim 18, wherein the UGI domain and the NLS are linked via a linker comprising the amino acid sequence: SGGS (SEQ ID NO: 4288), or wherein the Cas9 domain and the UGI domain are linked via a linker comprising the amino acid sequence: SGGS (SEQ ID NO: 4288).

22. The fusion protein of claim 1, wherein the fusion protein comprises the amino acid sequence set forth in SEQ ID NO: 594.

23. A complex comprising the fusion protein of claim 1 and the guide RNA bound to the Cas9 domain of the fusion protein.

* * * * *